US011519042B2

(12) United States Patent
Perot et al.

(10) Patent No.: US 11,519,042 B2
(45) Date of Patent: Dec. 6, 2022

(54) METHOD FOR THE DIAGNOSIS OR PROGNOSIS, IN VITRO, OF LUNG CANCER

(71) Applicant: BIOMERIEUX, Marcy l'Etoile (FR)

(72) Inventors: Philippe Perot, Lyons (FR); François Mallet, Villeurbanne (FR); Cécile Montgiraud, Unieux (FR); Nathalie Mugnier, Lyons (FR)

(73) Assignee: BIOMERIEUX, Marcy l'Etoile (FR)

( * ) Notice: Subject to any disclaimer, the term of this patent is extended or adjusted under 35 U.S.C. 154(b) by 197 days.

(21) Appl. No.: 14/367,872

(22) PCT Filed: Dec. 20, 2012

(86) PCT No.: PCT/FR2012/053012
§ 371 (c)(1),
(2) Date: Jun. 20, 2014

(87) PCT Pub. No.: WO2013/093353
PCT Pub. Date: Jun. 27, 2013

(65) Prior Publication Data
US 2015/0119265 A1    Apr. 30, 2015

(30) Foreign Application Priority Data

Dec. 20, 2011 (FR) ..................... 11/62089

(51) Int. Cl.
*C12Q 1/70* (2006.01)
*C12Q 1/6886* (2018.01)
*G01N 33/574* (2006.01)

(52) U.S. Cl.
CPC .......... *C12Q 1/702* (2013.01); *C12Q 1/6886* (2013.01); *G01N 33/57423* (2013.01); *C12Q 2600/118* (2013.01); *C12Q 2600/158* (2013.01)

(58) Field of Classification Search
CPC ............... C12Q 1/702; C12Q 1/6886; C12Q 2600/118; C12Q 2600/158; G01N 33/57423
See application file for complete search history.

(56) References Cited

U.S. PATENT DOCUMENTS

| | | | | |
|---|---|---|---|---|
| 2001/0053519 | A1* | 12/2001 | Fodor .................. | B01J 19/0046 435/6.11 |
| 2009/0297530 | A1 | 12/2009 | Wang-Johanning | |
| 2014/0349857 | A1* | 11/2014 | Mallet ............... | G01N 33/57419 506/2 |
| 2014/0370503 | A1* | 12/2014 | Mallet ................. | C12Q 1/6886 435/6.11 |
| 2015/0065368 | A1* | 3/2015 | Perot .................... | C12Q 1/6886 506/9 |
| 2015/0065369 | A1* | 3/2015 | Perot .................... | C12Q 1/6886 506/9 |
| 2015/0119265 | A1* | 4/2015 | Perot ..................... | C12Q 1/702 506/9 |

FOREIGN PATENT DOCUMENTS

| | | | | |
|---|---|---|---|---|
| EP | 2 340 851 A1 | 7/2011 | | |
| WO | WO 0246477 A2 | * | 6/2002 | ........... C07K 14/005 |
| WO | WO 02099055 A2 | * | 12/2002 | ............... C12Q 1/42 |

OTHER PUBLICATIONS

Stauffer (Cancer Immunity (2004) vol. 4, p. 2).*
Benner et al (Trends in Genetics (2001) vol. 17, pp. 414-418).*
Greenbaum et al (Genome Biology 2003, vol. 4, article 117, pp. 1-8).*
Cheung et al (Nature Genetics, 2003, vol. 33, pp. 422-425).*
Saito-Hisaminato et al. (DNA research (2002) vol. 9, pp. 35-45).*
Wu (Journal of Pathology, 2001, vol. 195, pp. 53-65).*
Munroe et al (Molecular and Cellular Biology (1990) vol. 10, pp. 3441-3455).*
Perot et al (PLOS One (2012) vol. 7, pp. e40194.*
NCBI Blast ( http://blast.ncbi.nlm.nih.gov/Blast.cgi, May 30, 2016.*
Fong (Cancer Research (1997) vol. 57, pp. 2256-2267).*
Meyerson (Nature Reviews Oct. 2010 pp. 685-696).*
Genbank Accession AL137063.11 (https://www.ncbi.nlm.nih.gov/nuccore/9581554?sat=43&satkey=4423065, May 18, 2005).*
Lower ( Proceedings National Academy of Science (1996) vol. 93, pp. 5177-5184).*
Gimenez (Nucleic Acids Research (2010)vol. 38, pp. 2229-2246).*
Andersson (International Journal of Oncology (1998) vol. 12, pp. 309-313).*
Wada (Genes & Development (1998) vol. 12, pp. 343-356).*
Blast RIDJ22ZMRY201R (https://blast.ncbi.nlm.nih.gov/Blast.cgi, downloaded Jun. 13, 2018).*
Kovalskaya (virology (2006) vol. 346, pp. 373-378).*
Gen Bank accession AC011895.4 (https://www.ncbi.nlm.nih.gov/nucleotide/AC011895.4?report=genbank&log$=nuclalign&blast_rank=1&RID=V38VGX9A015, Apr. 29, 2003).*
Genbank accession AC068643.27 (https://www.ncbi.nlm.nih.gov/nuccore/AC068643.27, Jan. 29, 2003).*
Bustin (Journal of Molecular Endocrinology (2002) vol. 29, pp. 23-29.*
Merriam Webster.com (https://www.merriam-webster.com/dictionary/suspect, downlaoaded May 20, 2020).*
Ahn ( Mol Cells (2009) vol. 28, pp. 99-103).*
Yi (Genes Gene System (2007) vol. 82, pp. 89-8).*

(Continued)

*Primary Examiner* — Steven Pohnert
(74) *Attorney, Agent, or Firm* — Oliff PLC (57) ABSTRACT

The subject matter of the present invention is a method for the diagnosis or prognosis, in vitro, of lung cancer, which includes a step of detecting at least one expression product of at least one HERV nucleic acid sequence, a method for use of said nucleic acid sequences, which have been isolated, as a molecular marker or molecular markers, and a kit including at least one binding partner specific for at least one of the expression products of the HERV nucleic acid sequences.

16 Claims, 2 Drawing Sheets
Specification includes a Sequence Listing.

(56) References Cited

OTHER PUBLICATIONS

Ishida (Cancer Immunity (2008) vol. 8, pp. 1-10).*
Yi (Cancer letters (2004) vol. 211, pp. 89-96).*
Yi cancer Letters (2006) vol. 231, pp. 228-239).*
Yi (J Hum Genet (2007) vol. 52, pp. 285-296).*
Ahn, Kung et al., "Structural and Quantitative Expression Analyses of HERV Gene Family in Human Tissues," Molecules and Cells, Aug. 31, 2009, vol. 28, No. 2, pp. 99-103.
Subramanian, Ravi et al., "Identification, Characterization, and Comparative Genomic Distribution of the HERV-K (HML-2) Group of Human Endogenous Retroviruses," Retrovirology, 2011, vol. 8, No. 1, pp. 1-22.
Gimenez, Juliette et al., "Custom Human Endogenous Retroviruses Dedicated Microarray Identifies Self-Induced HERV-W Family Elements Reactivated in Testicular Cancer Upon Methylation Control," Nucleic Acids Research, 2010, vol. 38, No. 7, pp. 2229-2246.
Paces, Jan et al., "HERVd: the Human Endogenous RetroViruses Database: Update," Nucleic Acids Research, 2004, vol. 32, pp. 1.
"Human DNA Sequence From Clone RP1-104L14 on Chromosome 6 contains the 3' End of the AKAP7 Gene for a Kinese (PRKA) Anchor Protein 7, Complete Sequence," XP002702741, pp. 1-42.
Liang, Qiaoyi et al., "Identification of a Novel Human Endogenous Retrovirus and Promoter Activity of its 5' U3," Biochemical and Biophysical Research Communications, 2009, vol. 382, No. 2, pp. 468-472.
Nickerson, Deborah A. et al., "DNA Sequence Diversity in a 9.7-kb Region of the Human Lipoprotein Lipase Gene," Nature Genetics, vol. 19, Jul. 1998, vol. 19, pp. 233-240.
Navarro, Gonzalo et al., "Flexible Pattern Matching in Strings," Cambridge University Press, 2002.
Irizarry, Rafael A., "Exploration, Normalization, and Summaries of High Density Oligonucleotide Array Probe Level Data," Biostatistics, 2003, vol. 4, No. 2, pp. 249-264.
Johnson, W. Evan et al., "Adjusting Batch Effects in Microarray Expression Data Using Empirical Bayes Methods," Biostatistics, 2007, vol. 8, No. 1, pp. 118-127.
Tusher, Virginia Goss et al., "Significance Analysis of Microarrays Applied to the Ionizing Radiation Response," PNAS, Apr. 24, 2001, vol. 98, No. 9, pp. 5116-5121.
Storey, John D. et al., "Statistical Signficance for Genomewide Studies," PNAS, Aug. 5, 2003, vol. 100, No. 16, pp. 9440-9445.

* cited by examiner

METHOD FOR THE DIAGNOSIS OR PROGNOSIS, IN VITRO, OF LUNG CANCER

Endogenous retroviruses constitute the progeny of infectious retroviruses which have integrated, in their proviral form, into germ line cells and which have been transmitted via this means into the genome of the progeny of the host.

The sequencing of the human genome has made it possible to reveal the extremely high abundance of transposable elements or derivatives thereof. In fact, repeated sequences represent close to half the human genome and endogenous retroviruses and retrotranposens make up 8% of said genome, with the number of elements, at the current time, coming to more than 400,000.

The abundance of endogenous retroviral elements (ERVs) currently present in the human genome is the result of about 100 endogenizations which have successfully taken place during the course of the evolution of the human line. The various waves of endogenization are spread out over a period ranging from 2 to 90 million years before our era and have been followed by the expansion of the number of copies via phenomena of the "copy/paste" type with the possibility of the appearance of errors, resulting, starting from an ancestral provirus, in the formation of a family of HERVs, i.e. a set of elements which exhibit sequence homologies. The oldest elements, those of the HERV-L family, supposedly became integrated before the emergence of mammals. Two families, HERV-F and HERV-H, appeared during the period when the first primates were mating their appearance. The HERV-FRD and HERV-K(HML-5) families, integrated 40 to 55 million years ago, are specific for higher primates. On the other hand, the HERV-W and HERV-E families, for example, became integrated 5 to 10 million years later, after the separation with New World monkeys, and are specific for the Catarrhini (Hominoids and Cercopithecidae).

The ERV sequences are represented on all the chromosomes, with a varying density according to the families, and there is no correlation between the physical proximity of ERVs and their phylogenetic proximity.

For a long time, ERVs have been considered to be parasites or to be simple DNA waste. Nevertheless, the impact of ERVs on the organism is not only limited to their past participation in modeling the genome or to deleterious recombinations which stay still provide support.

The abundance and the structural complexity of ERVs makes analyses of their expression very complicated and often difficult to interpret. The detection of HERV expression say reflect the transcriptional activation of one or more loci within the same family. The activated locus or loci may in addition vary according to the tissue and/or the context.

The present inventors have now discovered and demonstrated that nucleic acid sequences corresponding to precisely identified loci of endogenous retroviral elements are associated with rang career and that these sequences are molecular mar here of the pathological condition. The sequences identified are either proviruses, i.e. sequences containing all or part, of the gag, pol and env genes flanked in the 5' and 3' positions by long terminal repeats (LTRs), or all or part of the LTRs or of the genes isolated. The DNA sequences identified are respectively referenced as SEQ ID NO: 1 to 242 in the sequence listing, their chromosomal location is identified in the table below (NCBI 36/hg18), as are their expression, overexpression or underexpression represented by the "expression ratio" between cancer sample and normal sample. When the expression of the nucleic acid or the change in the expression of the nucleic acid is specific for lung tissue, this information is indicated by the sorbet "x" in the target tissue column. This signifies that, it an expression or a change in expression of the nucleic acid concerned is determined in a biological compartment other than lung tissue, this represents, remotely, a signature of lung cancer. The DNA sequences identified as being specific for lung tissue are respectively referenced as (SEQ ID NOs: 4, 5, 7, 9, 10, 12, 20, 25 and 40 in the sequence listing. The DNA sequences identified as being not specific for lung tissue are respectively referenced as SEQ ID NOs: 1, 2, 3, 6, 8, 11, 13, 14, 15, 16, 17, 18, 19, 21, 22, 23, 24, 26, 27, 28, 29, 30, 31, 32, 33, 34, 35, 36, 37, 38, 39, 41, 42, 43, 44, 45, 46, 47, 48, 43, 50, 51, 52, 53, 54, 55, 26, 27, 28, 29, 60, 61, 62, 63, 64, 63, 66, 67, 63, 69, 70, 71, 72, 73, 74, 75, 76, 77, 78, 79, 90, 81, 82, 83, 84, 85, 86, 87, 88, 89, 90, 91, 92, 93, 94, 95, 96, 97, 98, 99, 100, 101, 102, 103, 104, 102, 106, 107, 108, 109, 110, 111, 112, 112, 114, 115, 116, 117, 118, 119, 120, 121, 122, 123, 124, 125, 126, 127, 128, 129, 130, 131, 132, 133, 134, 133, 136, 137, 138, 132, 140, 141, 142, 143, 144, 143, 146, 147, 148, 149, 150, 151, 152, 153, 154, 155, 156, 157, 158, 159, 160, 161, 162, 163, 164, 165, 166, 167, 168, 169, 170, 171, 172, 173, 174, 173, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 213, 216, 217, 218, 219, 220, 221, 222, 223, 224, 225, 226, 227, 228, 229, 230, 231, 282, 233, 234, 235, 236, 237, 238, 239, 240, 241 and 242.

TABLE

| SEQ ID NO: | Chromosomal location | Target tissue | Cancer/normal expression ratio |
|---|---|---|---|
| 1 | (+) chr 19: 57753757-57754726 | | −4.8 |
| 2 | (−) chr 3: 32480101-32483411 | | −3.9 |
| 3 | (+) chr 3: 135222763-135223084 | | −3.7 |
| 4 | (+) chr 6: 131686129-131689771 | x | −3.5 |
| 5 | (−) chr X: 91414738-91420449 | x | −3.2 |
| 6 | (+) chr 7: 100274888-100276065 | | 3.2 |
| 7 | (−) chr 1: 154420719-154426128 | x | −2.9 |
| 8 | (+) chr 2: 231973667-231981798 | | −2.8 |
| 9 | (+) chr 2: 188084458-188084785 | x | −2.7 |
| 10 | (+) chr 6: 131658190-131664031 | x | −2.7 |
| 11 | (+) chr 2: 201711970-201712935 | | −2.7 |
| 12 | (−) chr 6: 82110364-82117596 | x | −2.7 |
| 13 | (+) chr 7: 93107183-93112802 | | 2.6 |
| 14 | (+) chr 6: 2833115-2833223 | | −2.5 |
| 15 | (−) chr 2: 71238414-71246247 | | −2.5 |
| 16 | (−) chr 17: 38571826-38572147 | | 2.5 |
| 17 | (+) chr 3: 133508751-133509387 | | −2.4 |
| 18 | (+) chr 20: 24856581-24861663 | | −2.4 |
| 19 | (+) chr 13: 108715439-108721465 | | −2.4 |
| 20 | (+) chr 7: 17420212-17426910 | x | −2.3 |
| 21 | (−) chr 2: 54587807-54590183 | | −2.3 |
| 22 | (−) chr 11: 49820917-49821387 | | −2.2 |
| 23 | (−) chr 1: 79726879-79732396 | | −2.2 |
| 24 | (−) chr 20: 15911118-15913833 | | 2.2 |
| 25 | (+) chr X: 93632019-93639453 | x | −2.2 |
| 26 | (−) chr 2: 58194071-58199769 | | 2.1 |
| 27 | (−) chr 1: 176376976-176378817 | | −2.1 |
| 28 | (−) chr 13: 112501931-112502014 | | −2.0 |
| 29 | (+) chr 3: 95139589-95145594 | | −2.0 |
| 30 | (−) chr 6: 27901601-27902447 | | 2.0 |
| 31 | (+) chr 8: 86591572-86592049 | | −2.0 |
| 32 | (+) chr 16: 55266229-55266680 | | 2.0 |
| 33 | (−) chr 2: 165222667-165224367 | | −2.0 |
| 34 | (+) chr 6: 152853219-152859441 | | −2.0 |
| 35 | (+) chr 6: 111558919-111565969 | | −1.9 |
| 36 | (+) chr 11: 73926652-73927082 | | −1.9 |
| 37 | (−) chr 19: 51297295-51305072 | | 1.9 |
| 38 | (−) chr 8: 138907724-138911942 | | −1.9 |
| 39 | (−) chr 1: 144779633-144780605 | | 1.9 |
| 40 | (−) chr 6: 32732881-32733838 | x | −1.9 |

TABLE-continued

| SEQ ID NO: | Chromosomal location | Target tissue | Cancer/normal expression ratio |
|---|---|---|---|
| 41 | (−) chr 1: 144779633-144780605 | | 1.9 |
| 42 | (−) chr 3: 130037918-130043560 | | −1.8 |
| 43 | (−) chr Y: 13388258-13388740 | | 1.8 |
| 44 | (+) chr 9: 34993290-34999333 | | −1.8 |
| 45 | (−) chr 12: 84386849-84387812 | | −1.8 |
| 46 | (+) chr 1: 13551727-13561236 | | −1.7 |
| 47 | (−) chr Y: 21547357-21548314 | | −1.7 |
| 48 | (+) chr 15: 49439487-49440297 | | −1.7 |
| 49 | (+) chr 2: 30592323-30596634 | | 1.7 |
| 50 | (+) chr 14: 73239795-73245370 | | −1.7 |
| 51 | (−) chr 12: 11656097-11659027 | | −1.7 |
| 52 | (−) chr 19: 46119961-46120936 | | −1.7 |
| 53 | (+) chr 17: 75988189-75996283 | | −1.7 |
| 54 | (+) chr 1: 204107496-204110550 | | −1.7 |
| 55 | (−) chr 1: 223094264-223100407 | | 1.7 |
| 56 | (−) chr 1: 89419377-89419778 | | −1.7 |
| 57 | (+) chr 7: 122244019-122250290 | | −1.7 |
| 58 | (+) chr 2: 231645891-231645949 | | 1.7 |
| 59 | (+) chr 1: 201726731-201727141 | | −1.6 |
| 60 | (−) chr 1: 12762845-12768665 | | −1.6 |
| 61 | (−) chr 1: 196365449-196366430 | | −1.6 |
| 62 | (−) chr 5: 170360805-170364300 | | −1.6 |
| 63 | (+) chr 11: 76938868-76944155 | | −1.6 |
| 64 | (−) chr 18: 64760486-64761450 | | −1.6 |
| 65 | (+) chr 7: 76807190-76813131 | | −1.6 |
| 66 | (−) chr 7: 128961001-128961758 | | −1.6 |
| 67 | (−) chr 16: 69214387-69217522 | | −1.6 |
| 68 | (−) chr 17: 59750387-59751101 | | −1.5 |
| 69 | (+) chr 19: 45269688-45270401 | | 1.5 |
| 70 | (+) chr 14: 22268133-22268207 | | −1.5 |
| 71 | (+) chr 10: 55596442-55602269 | | −1.5 |
| 72 | (+) chr 13: 55512386-55518412 | | −1.5 |
| 73 | (+) chr 19: 57816195-57826383 | | 1.5 |
| 74 | (−) chr 14: 24964620-24969975 | | −1.5 |
| 75 | (+) chr 7: 125337255-125351402 | | −1.5 |
| 76 | (−) chr 1: 171684177-171684627 | | −1.5 |
| 77 | (+) chr 13: 35788462-35794330 | | −1.5 |
| 78 | (−) chr 5: 143285967-143286088 | | 1.5 |
| 79 | (+) chr 18: 13646676-13647837 | | 1.5 |
| 80 | (−) chr 19: 60210007-60215603 | | −1.5 |
| 81 | (−) chr 4: 4052713-4058389 | | −1.5 |
| 82 | (−) chr 2: 62312529-62318338 | | −1.5 |
| 83 | (+) chr 3: 147554294-147559942 | | −1.5 |
| 84 | (−) chr 13: 60755266-60755331 | | −1.5 |
| 85 | (−) chr 15: 65048616-65056011 | | 1.5 |
| 86 | (−) chr 4: 4030945-4038383 | | −1.5 |
| 87 | (+) chr 13: 27913017-27913666 | | −1.5 |
| 88 | (+) chr 14: 101776047-101781857 | | 1.5 |
| 89 | (−) chr 5: 95528434-95530534 | | 1.4 |
| 90 | (−) chr 15: 85890568-85891324 | | −1.4 |
| 91 | (−) chr 6: 68639470-68641070 | | −1.4 |
| 92 | (+) chr 6: 63353796-63359590 | | −1.4 |
| 93 | (+) chr 6: 91950297-91950513 | | 1.4 |
| 94 | (−) chr 19: 20721466-20730278 | | −1.4 |
| 95 | (+) chr 16: 10506850-10507201 | | −1.4 |
| 96 | (+) chr 1: 146832410-146833382 | | 1.4 |
| 97 | (+) chr 8: 24149948-24150249 | | 1.4 |
| 98 | (+) chr 2: 34773168-34775448 | | −1.4 |
| 99 | (−) chr 11: 23865384-23871043 | | −1.4 |
| 100 | (+) chr 8: 98282174-98288062 | | 1.4 |
| 101 | (+) chr 19: 19756756-19757058 | | 1.4 |
| 102 | (−) chr 4: 135818540-135824157 | | −1.4 |
| 103 | (+) chr 3: 184711418-184714409 | | −1.4 |
| 104 | (+) chr 3: 75269085-75276706 | | 1.4 |
| 105 | (+) chr 2: 71468737-71476455 | | −1.4 |
| 106 | (−) chr 9: 73768007-73768097 | | −1.4 |
| 107 | (+) chr 5: 111807288-111815094 | | −1.4 |
| 108 | (+) chr 17: 70760297-70765658 | | 1.4 |
| 109 | (−) chr 6: 16064468-16065182 | | −1.4 |
| 110 | (+) chr 1: 4781688-4782412 | | −1.4 |
| 111 | (−) chr 16: 58106314-58114369 | | −1.4 |
| 112 | (+) chr 8: 91057690-91058157 | | 1.4 |
| 113 | (+) chr 2: 215375861-215376821 | | 1.4 |
| 114 | (−) chr 12: 17764451-17768938 | | 1.4 |
| 115 | (−) chr X: 112238600-112244308 | | −1.4 |
| 116 | (−) chr 5: 92818136-92819135 | | −1.4 |
| 117 | (−) chr 1: 79877033-79882760 | | −1.4 |
| 118 | (−) chr 4: 95433460-95438743 | | −1.4 |
| 119 | (+) chr 16: 29617077-29617563 | | −1.4 |
| 120 | (−) chr 5: 121980485-121987968 | | −1.4 |
| 121 | (−) chr 13: 55050362-55056223 | | 1.4 |
| 122 | (+) chr 18: 31049990-31056476 | | −1.4 |
| 123 | (−) chr X: 73258716-73266192 | | −1.3 |
| 124 | (+) chr 5: 55618832-55619003 | | −1.3 |
| 125 | (+) chr 3: 156178559-156179784 | | 1.3 |
| 126 | (−) chr 3: 45334152-45335128 | | 1.3 |
| 127 | (−) chr 5: 100347893-100353827 | | 1.3 |
| 128 | (−) chr 6: 161967666-161968129 | | 1.3 |
| 129 | (−) chr 21: 20291919-20292024 | | −1.3 |
| 130 | (−) chr 11: 3451335-3458971 | | −1.3 |
| 131 | (+) chr 8: 105367316-105373215 | | 1.3 |
| 132 | (+) chr 18: 2829330-2829995 | | −1.3 |
| 133 | (−) chr 13: 90298826-90304533 | | −1.3 |
| 134 | (−) chr 3: 180722967-180726830 | | −1.3 |
| 135 | (−) chr 8: 129693327-129699058 | | −1.3 |
| 136 | (+) chr 5: 5852293-5852397 | | 1.3 |
| 137 | (−) chr 6: 122854248-122854377 | | 1.3 |
| 138 | (−) chr 7: 5033421-5033757 | | 1.3 |
| 139 | (+) chr 6: 130555149-130561062 | | −1.3 |
| 140 | (+) chr 12: 94666771-94672799 | | −1.3 |
| 141 | (−) chr 9: 29178033-29178600 | | 1.3 |
| 142 | (+) chr 11: 40847438-40848141 | | −1.3 |
| 143 | (+) chr 11: 321893-322552 | | −1.3 |
| 144 | (−) chr 4: 167866387-167867014 | | −1.3 |
| 145 | (−) chr 1: 220215255-220218922 | | −1.3 |
| 146 | (−) chr 22: 37122490-37122813 | | −1.3 |
| 147 | (−) chr 2: 80956433-80960797 | | 1.3 |
| 148 | (+) chr 6: 63559535-63565316 | | −1.3 |
| 149 | (−) chr 18: 3013633-3013763 | | −1.3 |
| 150 | (−) chr 12: 20983776-20984452 | | 1.3 |
| 151 | (+) chr 6: 142192789-142193227 | | −1.3 |
| 152 | (+) chr 6: 125253252-125260608 | | 1.3 |
| 153 | (+) chr 4: 175540733-175541728 | | −1.3 |
| 154 | (−) chr 10: 65826993-65827758 | | −1.3 |
| 155 | (−) chr 8: 12395268-12398823 | | −1.3 |
| 156 | (+) chr 13: 61603944-61604298 | | 1.3 |
| 157 | (−) chr 3: 178866314-178871614 | | 1.3 |
| 158 | (−) chr 12: 20862483-2086818 | | −1.3 |
| 159 | (−) chr 10: 59523861-59524645 | | 1.3 |
| 160 | (−) chr 7: 79651365-79652053 | | 1.3 |
| 161 | (−) chr 11: 69581214-69582655 | | −1.3 |
| 162 | (+) chr 21: 44461476-44462142 | | 1.3 |
| 163 | (−) chr 2: 105967906-105968229 | | 1.3 |
| 164 | (+) chr 6: 123199111-123199590 | | 1.3 |
| 165 | (+) chr 9: 22813029-2281338 | | −1.3 |
| 166 | (−) chr 14: 41740538-41741242 | | 1.3 |
| 167 | (−) chr 18: 1990815-1991782 | | 1.3 |
| 168 | (+) chr 3: 8686697-8686961 | | −1.3 |
| 169 | (−) chr 2: 38161446-38167158 | | −1.3 |
| 170 | (−) chr 10: 101570559-101571639 | | 1.3 |
| 171 | (−) chr 15: 31130887-31131553 | | −1.3 |
| 172 | (+) chr 7: 65695119-65695525 | | −1.3 |
| 173 | (−) chr 8: 828875-829287 | | 1.3 |
| 174 | (+) chr 6: 160569673-160575346 | | −1.3 |
| 175 | (−) chr 10: 53463521-53469342 | | −1.3 |
| 176 | (−) chr 4: 176619310-176625331 | | 1.3 |
| 177 | (+) chr 12: 122598918-122609265 | | 1.3 |
| 178 | (−) chr 3: 78475709-78476509 | | −1.3 |
| 179 | (−) chr X: 37202604-37205422 | | −1.3 |
| 180 | (−) chr 1: 23196587-23203483 | | −1.2 |
| 181 | (+) chr 18: 38295804-38303710 | | −1.2 |
| 182 | (+) chr 4: 54581003-54585874 | | −1.2 |
| 183 | (+) chr 9: 35630300-35632824 | | 1.2 |
| 184 | (−) chr X: 8364892-8365592 | | 1.2 |
| 185 | (−) chr 6: 24784895-24791307 | | −1.2 |
| 186 | (−) chr 14: 79937761-79938478 | | −1.2 |
| 187 | (+) chr 2: 142963716-142969364 | | −1.2 |
| 188 | (+) chr X: 30031651-30037293 | | 1.2 |
| 189 | (+) chr 2: 63928103-63928550 | | 1.2 |
| 190 | (+) chr X: 92571323-92580146 | | −1.2 |
| 191 | (+) chr 7: 100353142-100354585 | | 1.2 |
| 192 | (+) chr 9: 113677404-113678370 | | −1.2 |

TABLE-continued

| SEQ ID NO: | Chromosomal location | Target tissue | Cancer/normal expression ratio |
|---|---|---|---|
| 193 | (+) chr 9: 129215427-129217168 | | -1.2 |
| 194 | (+) chr 4: 171274156-171279886 | | -1.2 |
| 195 | (-) chr 2: 52103626-52108242 | | -1.2 |
| 196 | (-) chr 2: 16846720-16847190 | | 1.2 |
| 197 | (+) chr 3: 187581597-187582311 | | -1.2 |
| 198 | (-) chr 12: 77758546-77759251 | | 1.2 |
| 199 | (-) chr 20: 740491-741481 | | 1.2 |
| 200 | (-) chr 3: 21205514-21210699 | | 1.2 |
| 201 | (-) chr 15: 49734758-49735530 | | -1.2 |
| 202 | (-) chr 3: 103933971-103934748 | | -1.2 |
| 203 | (-) chr 4: 177452380-177455182 | | 1.2 |
| 204 | (-) chr 9: 75103859-75104219 | | -1.2 |
| 205 | (+) chr 1: 237334832-237336987 | | -1.2 |
| 206 | (-) chr 13: 55584544-55586741 | | 1.2 |
| 207 | (-) chr 12: 29178820-29185001 | | -1.2 |
| 208 | (-) chr 20: 36760391-36760718 | | 1.2 |
| 209 | (+) chr 20: 32476466-32477455 | | 1.2 |
| 210 | (+) chr 4: 8492255-8492953 | | -1.2 |
| 211 | (+) chr 10: 65936583-65936972 | | 1.2 |
| 212 | (+) chr 11: 22761631-22761856 | | 1.2 |
| 213 | (+) chr 9: 133412422-133417146 | | -1.2 |
| 214 | (-) chr 4: 41854992-41855740 | | 1.2 |
| 215 | (+) chr 12: 60267154-60272981 | | -1.2 |
| 216 | (-) chr 3: 32477433-32480101 | | -1.2 |
| 217 | (+) chr 18: 70111304-70117249 | | -1.2 |
| 218 | (+) chr 19: 58554156-58559856 | | -1.2 |
| 219 | (+) chr X: 53557364-53557692 | | 1.2 |
| 220 | (-) chr 5: 34514678-34514916 | | -1.2 |
| 221 | (+) chr 6: 26107438-26108404 | | 1.2 |
| 222 | (-) chr 10: 6906147-6915609 | | 1.2 |
| 223 | (+) chr 1: 89162808-89170138 | | -1.2 |
| 224 | (+) chr 5: 741636041-74638012 | | 1.2 |
| 225 | (-) chr 5: 115707988-115708051 | | -1.2 |
| 226 | (-) chr X: 72938020-72941188 | | -1.1 |
| 227 | (+) chr Y: 26648032-26648192 | | 1.1 |
| 228 | (+) chr 18: 6123610-6123972 | | 1.1 |
| 229 | (-) chr 3: 110377937-110378340 | | -1.1 |
| 230 | (-) chr 9: 101942283-101948625 | | -1.1 |
| 231 | (+) chr 10: 100097920-100098685 | | 1.1 |
| 232 | (-) chr 4: 135768442-135768594 | | 1.1 |
| 233 | (+) chr 11: 18656991-18657966 | | 1.1 |
| 234 | (-) chr 7: 68382377-68383085 | | 1.1 |
| 235 | (-) chr X: 85929452-85930118 | | -1.1 |
| 236 | (+) chr 4: 1992875-1993855 | | -1.1 |
| 237 | (+) chr 5: 64505763-64506756 | | 1.1 |
| 238 | (+) chr 18: 8944363-8944760 | | 1.1 |
| 239 | (-) chr 1: 225849586-225850738 | | -1.1 |
| 240 | (+) chr 2: 199752333-199758641 | | -1.1 |
| 241 | (-) chr X: 137174181-137180160 | | -1.1 |
| 242 | (+) chr 9: 12938344-12944129 | | -1.1 |

The subject of the present invention is therefore a method for the in vitro diagnosis of lung cancer or for the in vitro prognosis of the seriousness of lung cancer in a biological sample taken from a patient, which comprises detecting at least one expression product of at least one nucleic acid sequence, said nucleic acid sequence being chosen from the full-length sequences identified in SEQ ID NOs: 1 to 242 or from the sequences which exhibit at least 99% identity, preferably at least 99.5% identity and advantageously at least 99.6% or at least 99.7% identity with one of the full-length sequences identified in SEQ ID NOs: 1 to 242.

The diagnosis makes it possible so establish whether or not an individual is ill. The prognosis makes it possible to establish a degree of seriousness of the disease (grades and/or stages) which has an effect on the survival and/or quality of life of the individual. In the context of the present invention, the diagnosis may be very early.

The percentage identity described above has beer; determined by taking into consideration the nucleotide diversity in the genome. It it is known chat nucleotide diversity is higher in regions or the genome that are rich in repeat sequences than in regions which do not contain repeat sequences. By way of example, Nickerson D. A. et al. (1) have shown a diversity of approximately 0.3% (0.32%) in. regions containing repeat sequences.

The ability to discriminate, a cancerous state of each of the sequences identified above has been demonstrated by evens of a statistical analysis using the SAM procedure (5), followed by correction by means oil the rate of false positives (6) and by elimination of the values below 2'. Consequently, each of the sequences identified above exhibits a significant difference in expression between a tumor state and a normal state. As a result oil this, a difference in expression observed for one of the above-mentioned sequences constitutes a signature of the pathological condition. Of coarse, it is possible to combine the differences in express ion noted for several of the sequences referenced above for example by one or snore combinations of 2, 3, 4, 5, 6, 7, 8, 9, 10 and more, or even up to 242 of the listed sequences. In particular:, the sequences identified in SEQ ID NOs: 1, 6 and 50, taken alone or in combination (in pairs or all three) constitute one or core preferred signatures.

Thus, in the tithed of the invention, at least two expression products respectively of at least two nucleic and, sequences are detected, said nucleic acid sequences being chosen from the sequences identified in SEQ ID NOs: 1 to 242 and in particular chosen from the sequences identified in SEQ ID NOs: 1, 6 and 50 or frost the sequences which exhibit au least 90% identity, preferably at least 99.52 identity and advantageously at least 99.6% or at least 99.7% identity with one of the abovementioned identified sequences.

In one embodiment of the method according to the invention, the expression product of at least two nucleic acid sequences is detected, said at least two nucleic acid sequences being chosen from the sequences identified as being specific for lung tissue, i.e. chosen from the group of sequences identified in SEQ ID NOs: 4, 5, 7, 9, 10, 12, 20, 25 and 40, in particular chosen from the .sequences identified in SEQ ID NOs 4, 5 and 7 or from the sequences which exhibit at least 99% identity, preferably at least 90.5% identity and advantageously at least 99.6% or at least 99.7% identity with One of the sequences identified in SEQ ID NOs: 4, 5, 7, 9, 10, 12, 20, 25 and 40 and in particular those which exhibit at least 99% identity, preferably at least 99.5% identity and advantageously at least 99.6% or at least 99.7% identity with one of the sequences identified in SEQ ID NOs: 4, 5 and 7.

In another embodiment of the method of the invention, the expression product of at least two nucleic acid sequences chosen from the sequences identified as being not specific for lung tissue, i.e. chosen from the group of sequences identified in SEQ ID NOs: 1, 2, 3, 6, 8, 11, 13, 14, 15, 16, 17, 18, 19, 21, 22, 23, 24, 26, 27, 28, 29, 30, 31, 32, 33, 34, 33, 36, 37, 38, 39, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 153, 159, 160, 161, 162, 163, 164, 165, 166, 167, 168, 169, 170, 171, 172, 173, 174, 175, 176, 177, 178, 179, 181, 162, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 252, 233, 234, 235, 236, 237, 238, 239, 240, 241 and 242, in particular the sequences chosen from the sequences identified in SEQ ID NOs: 1, 6 and 50 or chosen from the sequences which exhibit at least 99% identity, preferably at least 99.51 identity and advantageously at least 99.6% or at least 99.7% identity with one of the sequences identified in SEQ ID NOs: 1, 2, 3, 6, 8, 11, 13, 14, 15, 16, 17, 18, 19, 21, 22, 23, 24, 26, 27, 28, 29, 30, 31, 32, 33, 34, 35, 36, 37, 38, 39, 41, 42, 43, 44, 45, 46, 47, 48, 49, 50, 51, 52, 53, 54, 55, 56, 57, 38, 59, 60, 61, 62, 63, 64, 65, 66, 67, 68, 69, 70, 71, 72, 73, 74, 75, 76, 77, 78, 79, 80, 81, 82, 83, 84, 85, 86, 37, 88, 89, 90, 91, 92, 93, 94, 95, 96, 97, 98, 99, 100, 191, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 187, 138, 130, 140, 141, 142, 143, 144, 145, 146, 147, 148, 149, 150, 151, 152, 153, 154, 155, 156, 157, 158, 159, 160, 161, 162, 163, 164, 165, 166, 167, 163, 169, 170, 171, 172, 173, 174, 175, 176, 177, 178, 179, 180, 181, 182, 183, 184, 185, 186, 187, 188, 189, 190, 191, 192, 193, 194, 195, 196, 197, 196, 199, 200, 201, 202, 203, 204, 203, 206, 207, 208, 209, 210, 211, 212, 213, 214, 215, 216, 217, 218, 213, 220, 221, 222, 223, 224, 225, 226, 227, 228, 229, 230, 231, 232, 233, 234, 233, 233, 237, 238, 239, 240, 241 and 242, and in particular from the sequences which exhibit at least 99.5% identity and advantageously at least 99.6% or at least 99.7% identity with one of the sequences identified in SEQ ID NOs: 1, 6 and 50, is detected.

In yet another embodiment of the invention, the expression product of at least one sequence chosen from the sequences identified as being specific for lung tissue, i.e. chosen from the group of sequences; identified in SEQ ID NOs: 4, 3, 7, 3, 10, 12, 20, 25 and 40, in particular chosen from the sequences identified in SEQ ID NOs: 4, 5 and 7 and the sequences which exhibit at least 99.5% identity and advantageously at least 99.6% or at least 95.7% identity with one of the sequences above (i.e. the variants of said sequences) and at least one sequence chosen frosts the sequences identified as being not specific for lung tissue, i.e. the sequences identified in SEQ ID NOs: 1, 2, 3, 6, 8, 11, 13, 14, 15, 16, 17, 18, 19, 21, 22, 23, 24, 26, 27, 28, 29, 30, 31, 32, 33, 34, 35, 36, 37, 38, 39, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 135, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241 and 242, in particular the sequences identified in SEQ ID NOs: 1, 6 and 50 and their variants as defined above, is detected.

Preferably, in the method of the invention, the expression product of at least one nucleic acid sequence, preferably of at least two nucleic acid sequences or of three nucleic acid sequences is detected, said nucleic acid sequences being chosen from the group of sequences identified in SEQ ID NOs: 1, 6 and 50, or from the sequences which exhibit at least 99% identity, preferably at least 99.5% identity and advantageously at least 99.6% or at least 99.7% identity with the sequences identified in SEQ ID NOs: 1, 6 and 50.

The expression product detected is at least one RNA transcript, in particular at least one mRNA or at least one polypeptide.

When the expression product is an mRNA transcript, it is detected by any appropriate method, such as hybridization, sequencing or amplification. The mRNA may be detected directly by bringing into contact with at least one probe and/or at least one primer which are designed so as to hybridize to the mRNA transcripts under predetermined experimental conditions, demonstrating the presence or the absence of hybridization to the mRNA and optionally quantifying the mRNA. Among the preferred methods, mention may be made of amplification (for example, RT-PCR, NSBA, etc), hybridization on a chip or else sequencing. The mRNA may also be detected indirectly using nucleic acids derived from said transcripts, such as cDNA copies, etc.

Generally, the method of the invention comprises an initial step of extracting the mRNA from the sample to be analyzed.

Thus, the method may comprise:

(i) a step of extracting the mRNA from the sample to be analyzed, (ii) a step of detecting and quantifying the mRNA from the sample to be analyzed, (iii) a step of extracting the mRNA in a reference sample, which may be a healthy sample originating in the same individual, or (iv) a step of detecting and quantifying the mRNA from the healthy samples, (v) a step of comparing the amount of mRNA expressed in the sample to be analyzed and in the reference sample; it being possible for the determination of an amount of mRNA expressed in the sample to be analyzed which is different than the amount of mRNA expressed in the healthy reference sample to be correlated with the diagnosis or the prognosis of the seriousness of lung cancer (the difference in the amount of mRNA in the cancerous lung tissue relative to the amount of mRNA expressed in the healthy lung tissue being indifferently an expression, an overexpression or an underexpression);

and in particular:

(i) an extraction of the mRNA to be analyzed from the sample, (ii) a determination, in the RNA to be analyzed, of an expression level of at least one RNA sequence in the sample, said RNA sequence being the transcription product of at least one nucleic acid sequence chosen from the sequences identified in SEQ ID NOs: 1 to 292 or from the sequences which exhibit at least 92% identity, preferably at least 99.5% identity and advantageously at least 99.6% or at least 99.7% identity with one of the sequences identified in SEQ ID NOs: 1 to 242, and (iii) a comparison of the expression level of the RNA sequence(s) defined in (ii) with a reference expression level; it being possible for the determination of an expression level of the RNA to be analyzed which exhibits a difference relative to the reference expression level to be correlated with the diagnosis or the prognosis of lung cancer (as determined above); or (i) a step of extracting the mRNA from the sample to be analyzed, (ii) a step of detecting and quantifying the mRNA from the sample to be analyzed, (iii) a step of comparing the amount of mRNA expressed in the sample to be analyzed relative to an amount of reference mRNA, it being possible for the determination of an amount of mRNA expressed in the sample to be analyzed which is different than the amount of reference mRNA to be correlated with the diagnosis or the prognosis of lung cancer (the difference in the amount of mRNA in the sample to be analyzed relative to the amount of reference mRNA being indifferently an expression, an overexpression or an underexpression).

In one embodiment of the method of the invention, DNA copies of the mRNA are prepared, the DNA copies are brought into contact with at least one probe and/or at least one primer under predetermined conditions which allow hybridization, and the presence or absence of hybridization to said DNA copies is detected.

The expression product which is detected may also be a polypeptide which is the translation product of at least one of the transcripts described above. In this case, the polypeptide expressed is detected by bringing into contact with at least one specific binding partner of said polypeptide, in particular an antibody or an antibody analog or an aptamer. The binding partner is preferably an antibody, for example a monoclonal antibody or a polyclonal antibody which is highly purified or an antibody analog, for example an affinity protein with competitive properties (nanofitin™).

The polyclonal antibodies can be obtained by immunization of an animal with the appropriate immunogen, followed by recovery of the desired antibodies in purified form, by taking the serum of said animal, and separation of said antibodies from the other serum constituents, in particular by affinity chromatography on a column to which an antibody specifically recognized by the antibodies is bound.

The monoclonal antibodies can be obtained by means of the hybridoma technology, the general principle of which is summarized below.

Firstly, an animal, generally a mouse, is immunized with the appropriate immunogen, and the B lymphocytes of said mouse are then capable oil producing antibodies against this antigen. These antibody-producing lymphocytes are then infused with "immortal" myeloma cells (murine in the example) so as to give rise to hybridomas. The cells capable of producing a particular antibody and of multiplying indefinitely are then selected from the heterogeneous mixture oil cells thus obtained, each hybridoma is multiplied in the forms of a clone, each one resulting in the production of a monoclonal antibody in which the properties of recognition with respect to the protein may be tested, for example, by ELISA, by one-dimensional or two-dimensional Western blotting, by immunofluorescence, or using a biosensor. The monoclonal antibodies thus selected are subsequently purified, in particular according to the affinity chromatography technique described above.

The monoclonal antibodies may also be recombinant antibodies obtained by genetic engineering, using techniques well known to those skilled in the art.

Nanofitins™ are small proteins which, like antibodies, are capable of binding to a biological target, thus mating it possible to detect it, to capture it or quite simply to target it within an organism. They are presented, inter alia, as antibody analogs.

Aptamers are synthetic oligonucleotides capable of binding a specific ligand.

The invention also relates to the use of at least one nucleic acid sequence, once isolated, as a molecular marker for the in vitro diagnosis or prognosis of lung cancer, characterized in that said nucleic acid sequence consists of:

(i) at least one DNA sequence chosen from the sequences SEQ ID NOs: 1 to 242, or (ii) at least cue DNA sequence complementary to a sequence chosen from the sequences SEQ ID NOs: 1 to 242, or (iii) at least one DNA sequence which exhibits at least 99% identity, preferably at least 99.5% identity and advantageously at least 99.6% or at least 99.7% identity with a sequence as defined in (i) and (ii), or (iv) at least one DNA sequence which is the transcription product of a sequence chosen from the sequences as defined in (i), or (v) at least one RNA sequence which is the transcription product of a sequence chosen from the sequences which exhibit at least 99% identity, preferably at least 99.5% identity and advantageously at least 99.6% or at least 99.7% identity with a sequence as defined in (i).

In one embodiment, use is made of at least two nucleic acid sequences which consist of:

(i) at least two DNA sequences chosen from the sequences SEQ ID NOs: 1 to 242, preferably chosen from the sequences identified in SEQ ID NOs: 1, 2, 3, 6, 8, 11, 13, 14, 15, 16, 17, 18, 19, 21, 22, 23, 24, 26, 27, 28, 29, 30, 31, 32, 33, 34, 35, 36, 37, 38, 39, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 80, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 178, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 232, 234, 235, 236, 237, 238, 239, 240, 241 and 242 or their variants, in particular from the sequences identified in SEQ ID NOs: 1, 6 and 50 or their variants as defined above, or at least two sequences chosen from the sequences identified in SEQ ID NOs: 4, 5, 7, 9, 10, 12, 20, 25 and 40, in particular chosen from the sequences identified in SEQ ID NOs: 4, 5 and 7 or their variants as defined above, or else at least one DNA sequence chosen from the sequences identified in SEQ ID NOs: 1, 2, 3, 6, 8, 11, 13, 14, 15, 16, 17, 18, 19, 21, 22, 23, 24, 26, 27, 28, 29, 30, 31, 32, 33, 34, 35, 36, 37, 38, 39, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241 and 242 or their variants, in particular chosen from the sequences identified in SEQ ID NOs: 1, 6 and 50 or their variants as defined above and at least one sequence chosen from the sequences identified in SEQ ID NOs: 4, 5, 7, 9, 10, 12, 20, 25 and 40, in particular chosen from the sequences identified in SEQ ID NOs: 4, 5 and 7 or their variants as defined above, or (ii) at least two DNA sequences respectively complementary to at least two sequences chosen from at least two sequences as defined in (i), or (iii) at least two DNA sequences which exhibit respectively at least 99% identity, preferably at least 99.5% identity and advantageously at least 99.6% or at least 99.7% identity with two sequences as defined in (i) and (ii), or (iv) at least two RNA sequences which are respectively the transcription product of two sequences chosen from the sequences as defined in (i), or (v) at least two RNA sequences which are the transcription product of two sequences chosen from the sequences which exhibit at least 99% identity, preferably at least 99.5% identity and advantageously at least 99.6% or at least 99.7% identify with the sequences as defined in (i).

A subject of the invention is also a kit for the in vitro diagnosis or prognosis of lung cancer in a biological sample taken from a patient, which comprises at least one specific binding partner of at least, one expression product, of at least, one nucleic acid sequence chosen from the sequences identified in SEQ ID NOs: 1 to 242 or from the sequences which exhibit at least 99% identity, preferably at least 99.5% identity, advantageously at least 99.6% or at least 99.7% identity with the nucleic acid sequences identified in SEQ ID NOs: 1 to 242 and no more than 242 specific binding partners of the expression products of the nucleic amid sequences identified in SEQ ID NOs: 1 to 242 or of the nucleic acid sequences which exhibit at least 99% identity with the nucleic acid sequences identified in SEQ ID NOs: 1 to 242, preferably at least 99.5% identity and advantageously at least 99.6% or at least 99.7% identity with one of the sequences identified in SEQ ID NOs: 1 to 242.

In one embodiment, the kit comprises at least two respectively specific binding partners of at least two expression products of at least two nucleic acid sequences chosen from the sequences identified in SEQ ID NOs: 1 to 242 or from the sequences which exhibit at lease: 99% identity, preferably at least 99.5% identity and advantageously at least 99.6% or at least 99.7% identity with the nucleic acid sequences identified in SEQ ID NOs: 1 to 242 and no more than 242 specific binding partners of the expression products of the nucleic acre sequences identified in SEQ ID NOs: 1 to 242 or of the nucleic acid sequences which exhibit at least 99% identity, preferably at least 99.5% identity and advantageously at least 99.6% or at least 99.7% identity with the nucleic acid sequences identified in SEQ ID NOs: 1 to 242.

For example, the kit comprises at least two respectively specific binding partners of the expression product of at least two nucleic acid sequences chosen from:

(i) the group of sequences identified in. SEQ ID NOs: 1, 2, 3, 6, 8, 11, 13, 14, 15, 16, 17, 18, 19, 21, 22, 23, 24, 26, 27, 28, 29, 30, 31, 32, 33, 34, 35, 36, 37, 38, 39, 41, 42, 43, 44, 45, 46, 47, 48, 49, 50, 51, 52, 53, 54, 55, 56, 57, 58, 59, 60, 61, 62, 68, 64, 65, 66, 67, 68, 69, 70, 71, 72, 73, 74, 75, 76, 77, 76, 70, 80, 81, 32, 83, 84, 65, 86, 87, 88, 89, 90, 91, 92, 93, 94, 95, 96, 97, 98, 99, 100, 101, 102, 103, 104, 105, 106, 107, 108, 103, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 143, 146, 147, 148, 149, 150, 151, 152, 153, 154, 155, 156, 157, 138, 159, 160, 161, 162, 163, 164, 165, 166, 167, 166, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 210, 220, 221, 222, 223, 224, 225, 226, 227, 228, 229, 230, 231, 232, 233, 234, 235, 236, 237, 238, 239, 240, 241 and 242, in particular chosen from, the sequences identified in SEQ ID NOs: 1, 6 and 50.

(ii) the group of sequences identified in SEQ ID NOs: 4, 5, 7, 9, 10, 12, 20, 25 and 40, in particular the sequences identified in SEQ ID NOs: 4, 5 and 7, (iii) from, the group of sequences consisting of at least one DNA sequence chosen front the sequences identified in SEQ ID NOs: 1, 2, 3, 6, 8, 11, 13, 14, 15, 16, 17, 18, 19, 21, 22, 23, 24, 26, 27, 28, 29, 30, 31, 32, 33, 34, 35, 36, 37, 38, 39, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 136, 157, 158, 159, 160, 161, 162, 163, 164, 165, 166, 167, 168, 169, 170, 171, 172, 173, 174, 175, 176, 177, 178, 179, 180, 181, 102, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 230, 239, 240, 241 and 242, in particular chosen from the sequences identified in SEQ ID NOs: 1, 6 and 50 or the sequences which exhibit at least 99% identity with the sequences identified in SEQ ID NOs: 1, 6 and 50 and of at least one sequence chosen from the sequences identified in SEQ ID NOs: 4, 5, 7, 9, 10, 12, 20, 25 and 40 and in particular chosen from the sequences identified in SEQ ID NOs: 4, 5 and 7 or the sequences which, exhibit at least 99% identity with the sequences identified in SEQ ID NOs: 4, 5 and 7, or (iv) from the groups of sequences which, exhibit at least 99% identity, preferably at least 99.5% identity and in particular at least 99.6% or 99.7% identity with the sequences identified in the groups of sequences as described in (i), (ii) or (iii).

In particular, the kit comprises 1, 2 or 3 specific binding partner(s) of the expression product(s) of the nucleic acid sequences identified in SEQ ID NOs: 1, 6 and 50 or of the sequences which exhibit at least 99% identity, preferably at least 99.5% identity and advantageously at least 99.6% or at least 99.7% identity with, the sequences identified in SEQ ID NOs. 1, 6 and 50.

The at least specific binding partner of the expression product corresponds to the definitions given above.

The invention also relates to a method for evaluating the efficacy of a treatment and/or a progression in lung cancer, which comprises a step of obtaining a series of biological samples, and a step of detecting at least one expression product of at least one nucleic acid sequence in said series of biological carries, said nucleic acid sequence being chosen from the sequences identified in SEQ ID NOs: 1 to 242, with one of the sequences identified in SEQ ID NOs: 1 to 242 or of the sequences which exhibit at least 99% identity, preferably at least 99.5% identity and advantageously at least 99.6% or at least 99.7% identity with, the sequences identified in SEQ ID NOs: 1 to 242.

In one embodiment, at least two expression products of at least two nucleic acid sequences are detected, said two nucleic acid sequences being chosen from the sequences identified in SEQ ID NOs; 1 to 242 or frets the sequences which exhibit at least 99% identity respectively, preferably at least 99.5% identify and advantageously at least 99.6% or at least 99.7% identity with the sequences identified in SEQ ID NOs: 1 to 242.

In another embodiment of the method, the expression product of at least: one nucleic acid sequence, preferably of at least two nucleic acid sequences or of three nucleic acid sequences is detected, said nucleic acid sequences being chosen from the group of sequences identified in SEQ ID NOs: 4, 5, 7, 9, 10, 12, 20, 25 and 40 and in particular from the sequences identified in SEQ ID NOs: 4, 5 and 7 or from the sequences which exhibit at least 99% identify wish the sequences identified in SEQ ID NOs: 4, 5, 7, 9, 10, 12, 20, 25 and 40 and in particular from the sequences which exhibit at least. 99% identity with the sequences identified in SEQ ID NOs: 4, 5 and 7.

In yet another embodiment of the method of the invention, the expression product, or at least one nucleic acid sequence, preferably of at least two nucleic acid sequences or of three nucleic acid sequences is detected, said nucleic acid sequences being chosen from the group of sequences identified in SEQ ID NOs: 1, 6 and 50 or from the sequences which exhibit at least 99% identity respectively, preferably at least 99.5% identity and advantageously at least 99.6% or at least 99.7% identity with the sequences identified in SEQ ID NOs: 1, 6 and 50.

The term "biological sample" is intended to mean a tissue, a fluid, components of said tissue and fluid, such as cells or apoptotic bodies, and excreted vesicles, comprising in particular exosomes and microvesicles. By way of example, the biological, sample may be derived from a biopsy of the lung carried out beforehand in a patient suspected of suffering from lung cancer or may be derived from a biopsy carried out on an organ other than the lung in a patient presenting metastases. In this second case, when the change in expression of the nucleic acid (molecular marker) is specific for the lung organ, it is possible to work back to the primary cancer, i.e. to the lung cancer. The biological sample may also be a biological fluid, such as blood or a blood fraction (serum, plasma), urine, saliva, cerebrospinal fluid, lymph, maternal milk, sperm, and also components of said fluids, in particular excreted vesicles as defined above. For example, the detection of a transcript specific for the lung tissue in an exosome or a microvesicle, originating from an epithelial cell, is a sign of the presence either of a primary cancer or of metastases, without it being necessary to take a sample at the level of the organ.

FIGURES

FIG. 2 shows the statistical differences in expression of HERV elements between normal lung and tumoral lung.

EXAMPLES

Example 1

Identification of HERV Sequences Exhibiting Differential Expression in Lung Cancer Method:

The identification of HERV sequences exhibiting differential expression in lung cancer is based on the design, and the use of a high-density DNA chip in the GeneChip format, called HERV-V2, designed by the inventors and the fabrication of which was subcontracted to the company Affymetrix. This chip contains probes which, correspond to HERV sequences that are distinct within the human genome. These sequences were identified using a set of prototypical references cut up into functional regions (LTR, gag, pol and env), and then, by means of a similarity search on the scale of the whole human genome (NCBI 36/hg18), 10 035 distincts HERV loci were identified, annotated and finally grouped together in a databank called HERVgDB3.

The probes which are part of the composition of the chip wore defined on the basis of HERVgDB3 and selected by applying a hybridization specificity criterion, the objective of which is to exclude, from the creation process, the probes having a high risk of hybridization, with an undesired target. For this, the HERVgDB3 sequences were first segmented in sets of 25 overlapping nucleotides (25-mers), resulting in a set of candidate probes. The risk of nonspecific hybridization was then evaluated for each candidate probe by performing alignments on the whole of the human genome using the KASH algorithm (2). An experimental score marks the result of the hybridization, addition of the impact of the number, of the type and or the position of the errors in the alignment. The value of this score correlates with the target/prone hybridization potential. Knowledge of all the hybridization potentials of a candidate probe on the whole of the human genome cakes it possible to evaluate its capture specificity. The candidate probes which exhibit good capture affinity are retained and then grouped together in "probe sets" and, finally, synthesized on the HERV-V2 chip.

The samples analyzed using the HERV-V2 high-density chip correspond, to RNAs extracted from tumors and to RNAs extracted from the healthy tissues adjacent to these tumors. The tissues analyzed are the long, with breast, ovary, uterus, prostate, colon, testicle and placenta as controls. In the case of placenta, only healthy tissues were used. For each sample, 50 ng of RNA were used, for the synthesis of cDNA using the amplification protocol known as WTO. The principle of WTO amplification is the following: random primers, and also primers targeting the 3' end of the RNA transcript, are added, before a step of reverse transcription followed, by a linear, single-stranded amplification denoted SPIA. The cDNAs are then assayed, characterized in purified, and then 2 μg are fragmented, and labeled with biotin at the 3' end via the action of the terminal transferase enzyme. The target product thus prepared is mixed with control oligonucleotides, then the hybridization is carried out according to the protocol recommended by the company Affymetrix. The chips are then visualized and read in order to acquire the image of their fluorescence. A quality control based on standard controls is carried out, and a set of indicators (MAD, MAD-Med plots, RLE) serve to exclude the chips that are not in accordance with a statistical analysis.

The analysis of the chips first consists of a preprocessing of the data through the application of a correction of the background noise based on the signal intensity of tryptophan probes, followed by RMA normalization (3) based on the quantile method. A double correction of the effects linker: to the batches of experiments is then carried out by applying the COMBAT method (4) in order to guarantee that the differences in expression that are observed are of biological and not technical origin. At this stage, an exploratory analysis of the data is conducted using tools for grouping together data by Euclidean partitioning (clustering) and, finally, a statistical analysis using the SAM procedure (5) followed by a correction via the rate of false positives (6) and elimination of the values below 2° is applied in order to search for sequences exhibiting a differential expression between the normal state and the tumor state of a tissue.

Results:

The processing of the data generated by the analysis of the HERV-V2 DEA chips using this method made it possible to identify a set of "probe sets" exhibiting a statistically significant difference in expression between the normal lung and the tumoral lung. The results of the clustering and also the search for differential expression within the control samples moreover demonstrated HERV elements of which the differential expression is specifically associated with the tumoral lung.

The nucleotide sequences of the HERV elements exhibiting a differential expression in the tumoral lung are identified by SEQ ID NOs: 1 to 242, the chromosomal location, of each sequence is given in the NCBI reference 36/hg18, and the "target tissue" information (a cross) indicates the elements in which the differential expression was observed only in the comparison between normal lung and tumoral lung (compared with the comparisons within the control tissues). A value which is an indication of the ratio of expression between normal state and tumor state is also provided, and serves to order the sequences in the interests of presentation only.

Example 2

Detection of HERV Sequences in Biological Fluids

Principle:

The inventors have shown that HERV sequences are detected in biological fluids, which makes it possible, inter alia, to characterize a lung cancer through recourse to remote detection of the primary organ. A study was carried out on 20 urine samples and 38 serum samples originating from different individuals.

The sera and the urines were centrifuged under the following conditions:

Sera: 300 g for 10 minutes at 4° C. The supernatant was recovered and centrifuged again at 16 500 g for 20 minutes at 4° C.. The supernatant of this second centrifugation, devoid of cells, but also comprising exosomes, microvesicles, nucleic acids and proteins, was analyzed on chips. The chip is the HERV-V2 chip used according to the modes previously described.

Urines: after collection, centrifugation at 800 g for 4 minutes at 4° C. The pellet was recovered with RNA protect cell reagent™. Then, centrifugation at 5000 g for 5 minutes before addition of the lysis buffer to the pellet. The chip is the HERV-V2 chip used according to the modes previously described.

Figure 1:
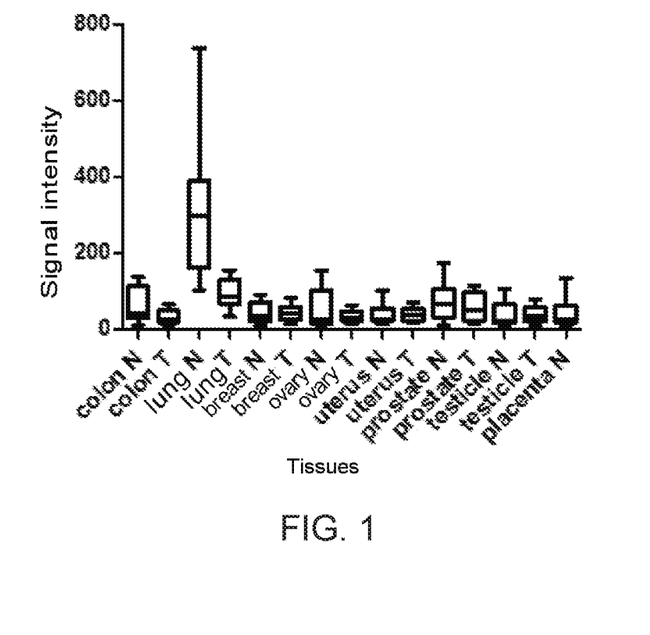
FIGS. 1 and 2 represent the differential expression observed in lung cancer for a set of HERV sequences. More specifically, FIG. 1 (clustering) groups together in an exploratory manner the HERV elements which have an expression tropism associated with the normal lung compared with ail the control tissues and cancerous tissues.
Figure 2:
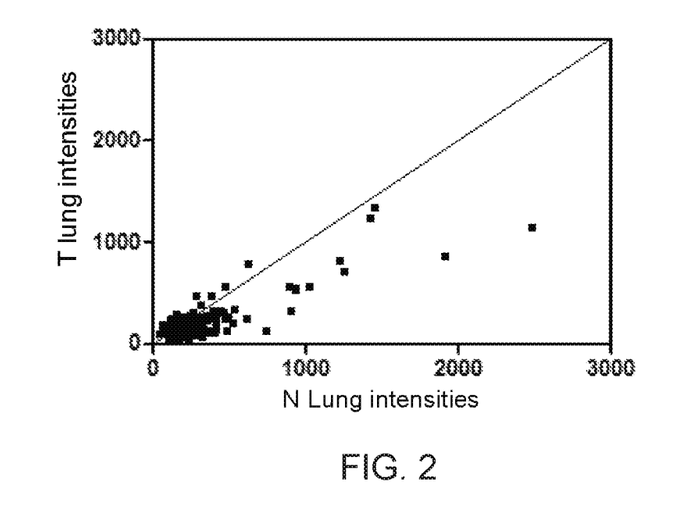
Figure 3:
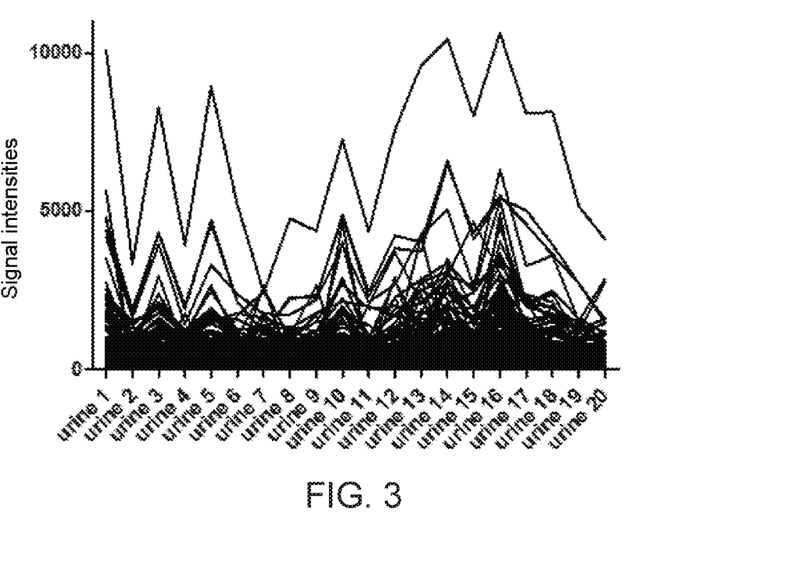
FIGS. 3 and 4 show the defection of HERV sequences in two biological fluids: urines and sera.
Figure 4:
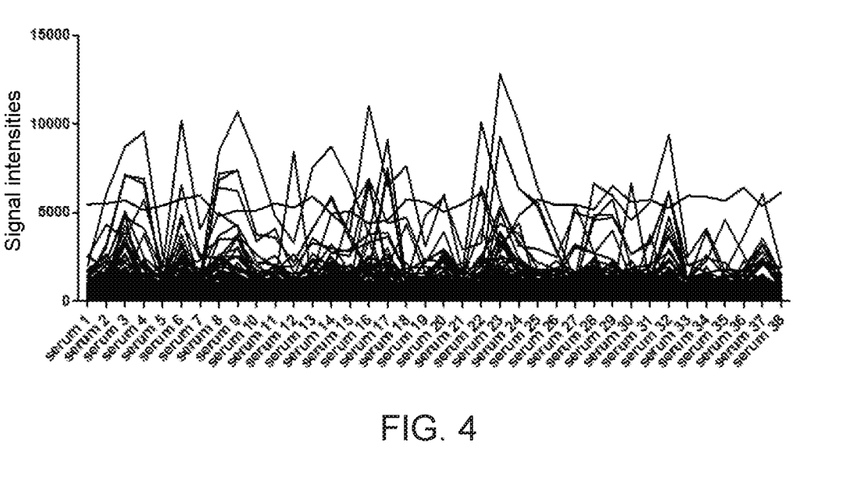

Results;

A large number of positive signals, including the expression signals corresponding to the sequences listed its the table above, was detected both in the serums supernatants and in the cell pellets originating from urines, as illustrated in figures 3 and 4, This confirms that biological fluids, in particular serum and urine, are a usable source of biological material for the detection of HERV sequences. It is commonly accepted that the positivity threshold is about 2°, i.e. 64.

LITERATURE REFERENCES

1. Nickerson, D. A., Taylor, S. L., Weiss, K. M., Clark, A. G., Hutchinson, R. G., Stengard, J., Salomaa, V., Vartiainen, E., Boerwinkle, E. and Sing, C. F. (1998) DNA sequence diversity in a 9.7-kb region of the human lipoprotein lipase gene. *Nat. Genet.*, 19, 233-240.
2. Navarro, G. and Raffinot, M. (2002) Flexible Pattern Matching in. Strings: Practical On-Line Search Algorithms for Texts and Biological Sequences. Cambridge University Press.
3. Irizarry, R. A., Hobbs, B., Collin, F., Beazer-Barclay, Y. D., Antonellis, K. J., Scherf, U. and Speed, T. P. (2003) Exploration, normalization, and summaries of high density oligonucleotide array probe level data. *Biostatistics (Oxford, England)*, 4, 249-264.
4. Johnson, W. E., Li, C. and Rabinovic, A. (2007) Adjusting batch streets in microarray expression data using empirical Bayes methods, *Biostatistics (Oxford, England)*, 8, 118-127.
5. Tusher, V. G., Tibshirani, R. and Chu, G. (2001) Significance analysis of microarrays applied to the ionizing radiation response. *Proceedings of the National Academy of Sciences of the United States of America*, 98, 5116-5121.
6. Storey, J. D. and Tibshirani, R. (2003) Statistical significance for genomewide studies. *Proceedings of the National Academy of Sciences of the United States of America*, 100, 9440-9445.

SEQUENCE LISTING (242 sequences)

SEQ ID NO: 1 - DNA, 969 bp, Homo sapiens
gaattgtggggaaaagagagagatcagactgttactgtgtctatgtagaaagaagtagacataagagactacattttgttctgtactaagaaaaattcttctgccttgagatgctgtgaatctgtaaccctagccccaaccctgtgctggcagaaacatgtgctgtgtcaactcaaggttaaatggattaagggctgttcaggatgtgctttgttaaacaaatgctagaagacagcgtgcttgttaaaagtcatcaccactccttactctcaagtacccagggacacagaacactgcgaaaggccgcaggaacctctgcctaggaaagccaggtattgtccaaagtttctcccatgtgatagcctgagatatggcctcatgggaagggaaagacctgaccatcccccagcccaacacccgtaaagggtctgtgctgaggaggattagtaaaagaggaaggcctctttgcagttgaggtaagaggaaggcatctgtctcctgctggtccctggacaatggaatgtctcggtgtaaagcccaattgtatattccatctactgagataggagaaaactgccttagagctggaggtgagacatgctggaggcagtactgctctttaaggcattgagatgtttatgtatatgcacatcaaaagcacagcactttttcctttaccttgtttatgacagagacatttgttcaggttttcctgctgaccctctctccactattaccttattgtcctgccacatccccctctccgagatggtagagataatgatcaataaatactgagggaactcagaggccggtgcaggcgcgggtcctctgtatgctgagtgctggtcctgtaggcctacttttctttctctgtactttgtctctatgtctctttcttttctcaaatctctccgttccacctgacgagaaatgcccacaggtgtggaggggcaggccaccccttca

SEQ ID NO: 2 - DNA, 3310 bp, Homo sapiens
gtcaggcctctaagcccaagctaagccatcatatcccctgtgacctgcacgtacacatccagatggccagttcctgccttaactgatgacattccaccacaaaagaagtgaaaatggcctgttcctgccttaactgatgatattatcttgagaaattccttctcctggctcatcctggctcaaaagctcccctactgagcaccttgtgacccccactcctgcccgccagagaacccccctttgactgtaattttcctttacctacccaaatcttataaaacggccccaccccatcttccttcgctgactcccttttcggactcagcccgcctgcacccaggtgattaaaagctttattgctcacacaaagcctgtttggtggtctcttcacacggacgcacatgaaatttggtgctgtgactcggatcgggggacctcccttgggagatcaatcccctgtcctcctgctctttgctccgtgaaaaagatccacctatgacctcaggtcctcagacccaccagcccaaggaacatctcaccaattttaaatcaggtaagcagcctctttttactctcttctccaacctccctcactattcctcaacctttctcctctcaatcttgatgccacacttcaatctctgccttctcttaatttcaattcttttcattttctggtagagacaaaggagacacgttttatctatggacctaaaactctggcgccggtcatggactgggaaggcagccttcccttggtgtttaatcattgcagggacgcctgattattcacccacgtttcagaggtgtcagaccacgcagggacgcctgccttggtccttcaccctttgaggcaagtcccactttcctggaggagggacaagaaccccaacctcttatctctgtgccccatcccttttttccgtgccctgaccccttttccacttttctggagggtaagaatcccccaccccttctccgtgtctctactctcctttctctgggcttgcctccttcactatgggcaagcttccaccttccattcctccttcttctcccttagcccgtgttcttaagaacttaaaacctcttcaactcactcctgacctaaaacctaaatgccttattttcttctgcaatgccgcttgaccccaatacaaactcgacagtagttccaaatagccggaaaacggcactttcaatttttccatcctacaagatctaaataattcttgtcgtaaaataggcaaatggtctgaggtgcctgatgtccaggcattcttttacacatcggtccctccctagtctctgttcccaatgtgactcgtcccaaatcttccttctttccctcccacctgtccccagtcccaaccccaagcgtcgctgagtctgtctaatcttccttttctacagacccatctgacctctcccctcaccaggccaagcgaggtctcaattcttcctcagcctccgctcctccaccctataatccttttatcccctcccctcctcacacccagtccagcttatagtttcgttccgtgactagccctccccaacctgcccagcaatttactcttagaaaagtggctggagctaaaggcatagtcaaggttaatgctcctttttctttatcccaaatcagagagcgtttaggctcttcttcatcaaatataaaaacccagcccagttcatggctcgttcggcagcaaccctgagatgctttatagccctagatcctaaaaggtcaaaaggccgtcttattctcaatatacattgtattacccaatctgctcccaacattaaataaagctccaaaaattaaattccggccctcaaaccccacaacaggacttacttaaccttgccttcaaggtgtacaataatagagtagaggcagccaagtagcaacatatttccgagttgcaattccttgcctccactgtgagacaaactccagccacatctccagcacacaagaacttccaaacgcctgaaccgcagtggctaggtgtacatccagaactgcctcccccaggagcttgctacaagtgccagaaatctggccaccaggccaaggaatgcccgcagcccaggattcctcctaagccgtgtcccatctgtgcaggaccccactggaaatcggactgttcaactcacctggcagccactcccagagcccctggaactctggctgaaggctctctgactccttcccagatcttctcggcttagcagctgaagactgacaccgcctgattgcctcagaagcttacaggaccatcacagacgctctaagtaactctcacagtggagagtaagtccgtccccttcttaatacggaggctacccactccacattaccttcttttcaagggcctgtttctcttgcctccataactgttgtaggtattgacagtcaagcttctaaacctcttaaaactcctcaaatctggtgccaacttagacaatactcttttaagcactcctttttagttatccccacctgcccagttcccttattaggccgagacactttaactaaactatctgcttccctgactattcctggactaaggctacatctcattgctgcccttcttcccaatccaaagcctcctttgcgtcctcctcttgtatccccccaccttaacccacaagtataatatacctctactccctccttggtgaccgatcatggaccccttaccatctcattaaaacctaatcacccttaccccgctcaatgccaatatcccatcccacagcatgctttaaaaagattaaagcctgttatcactcgcctgctacagcatggccttttaaagcctataaactctacttacaattcccccatttcacctgtcctcgaaccagacaagccttacaggttagttcaggatctgagccttatcaaccaaattgttttgcctacccatcctgtggtgccaaacccatatactctcctatcctcaatatctccctctactacccattattctgttctggatctcaaacacgctttctttactattcctttgcacccttcatcccagcctctcttcgctttcacttggactgaccctgacactcattaggctcagcaaattacctgggctgtactgccgcaaggcttcacagacaggtcccattacttcagtcaagcccaaatttcatccccatctgttacctatctgggcataattctcataaaaacacacgtgctctccctgctgatcgtatctgactaatctcccaaacctcaatcccttacaaaacaacaactcctttccttcctaggcatgcttag

SEQ ID NO: 3 - DNA, 321 bp, Homo sapiens
taggtcaggcacaaataagcccaccctactaggaactatgttgaaaaatttcaaaaaagaatttaaaggagactatggagtactgtgacactaggaaaacttaaaactttgtgtaagatagactggccagcattagaggtaagttggccattagaaggaagcctggacaggtcccttgtttcaaaggtgtggcccaaggtaacctgtaagccagggaatgcagaccagttcctgtacatagacacttggttacagctggttttagaccccccgcccccaacacacagtggttgagagaacagcagcataagtggctggcag

SEQ ID NO: 4 - DNA, 3642 bp, Homo sapiens
gtcaggcctctgagcccaagccaagccatcgcatcccctgtgacttgcacgtataagcccagatggcctgaagtaactgaagaatcacaaaagaagtgaatatgccctgccccaccttaactgatgacattccactacaaaagaagtgaaaatggccggtccttgccttaagtgatgacattaccttgtgaaagtccttttcctggctcatcctggctcaaaaacctcccccactgagcacctttcgaccccgactcctgcccgccagagaacaaaccccctttgactgtaattttcctttacctacccaaatcctataaaacagccccacccttatctcccttcactgactctcttttccgactcagcctacctgcacccaggtgaaataaacagccatgttgctcacgcaaagcctgtttggtggtctcttcacacggacgcgcatgaaatttggtgccgtgacttggatcgggggacctcccttcggagatcaatcccctgtcctcctgttctttgctccatgagaaagatccacctacgacctcaggtcctcagactgaccagcccaagaaacatctcaccaatttcaaatccggtaagcggcctctttttactctcttctccaacctccctcactatccctcaacctctttctcctttcaatcttggcgccacacttcaatctctgccttctgttaatttcaattcctttcattttctggtagagacaaaggagacactttttatccgtggacccaaaactccggcgccagtcacggactaggaaggcagccttcccttggtgtttaatcattgcagggacacctctctgattattcacccatgtttcaaaggtgtcagaccactcagggacacctgccttggtccttcacccttagcggcaagtcctgcttttctggggaaggggcaagtaccccaactctttctctccttgtctctaccccttctctgcttttctgggggaggggcaagtacccctcaaccccttctccttcacccttagcagcaagtcccgcttttccagaggaggggcaagtaccccaacctcgtatctctgtgccccaatcccttatttccacgccacaacctcttatatctctgcaccccagtcccttatttccacaccctgacttcttatctctgcaccccaatcccttatttccatgccccgaccccttatttctgtgccccgaccccttatttccatgccccgaccccttatttctgcaccccatcccttatttctgtgccgcaacctcttatctctgtgccccaaccccttttcccacttttctagaaggtaagaacccccgaaccccttccctccatttctctactctctcttttctctaggcttgcttccttcactataggcaactttccaccctccattcctccttctactcccttaacctgtgttctcaaaaacttaaaacctcttcaactcacacctgacctaaaacctaaatgtcttattttcttctgcaatgctgcttgaccccaatacaaactcgacagtagttccaaatagccagaaaacggcactttcaatttttccattctacaagatctaaatacttcttatcgtaaaataggcaaatggtctgaggtgactgacgtccaggcattttttacacatcagtcccttcctagtctctgtgcccagtgcaactcgtcccaaatcttctttcccttccgcctgtcccctcagtcccaaccccatgcatcactgagtctttctaatcttctttttctacagacccatctgacctctaccctcctcgccaggccaagctaggtcccaattcttccaccctataatctttttattgcctcccctcctcatacctggtccggcttacagtttccttccgtgactagccctcccccacctgcccagcaatttcctcttaaaaaggtggctggagccaaaggcatagtcaaggttaatgctcctttctctttatcccaaatcagatagcgtttaggctctttttcatcaaatataaaaacccagcccagttcatgtctcattcggcagcaaccctgcgacgctttacagccctagaccctaaaaggtcaaaaggccatcttattctcaatatacattttattacccaatctgctcctgacattaaataaaactccaaaaattagaatctggccctcaaacctcacaacaggatttaattaacctcaccttcaaggtgtacaataatagaaaaaagttgcaattccttgcctccactgtgagacaaaccccagccacatctccagcacacaagaaattccaaacacctgaaccacagcggccaggcattcctccagaacctcctcccccaggagcttgctacaagtgccagaaatctgaccaccaggccaaggaatgcctgcagcccaggattcctcctaagccgtgtcccatttgtgcaggaccccactggaaatcggactgttcaactcacctggcagccactcccggagcccctggaactctggcccaagactctctgactgactccttctcggcttagcggctgaagactgacgctgcccggtcgcctcggaagccccgtagaccatcagggacgccgagctttgggtaactctcacagtggaaggtaagcccgtccccttcttaatcaatacagaggctacccactccacattaccttcttttcaagggtctgtttcccttgcctccataactgttctaggtattgacggccaggcttctaaacctcttaaaactccccaaatctagtgccaacttagacaatactcttttaagcactcctttttagttatccccacctgcccagttcccttattaggctgagacactttaactaaattatctgcttccctgactgttcctggactacagctgtatctcattgccgcctttcttcccaatccaaagcttcctttgcgtcctcctcttgtatccccccaccttaacccacaagtataagatacctctactccctccttggtgaccgatcatgcaccccttaccgtgtcattaaaacctaatcacccttaccccactaaatgccaatatcccatcccgcagcacgctttaaaaagattaaagcctgttatcactggcctgctacagcatggccttttaaagcctataaactctccttataattcccccattttacccatcctaaaactgcacaagtcttacagattagttcaggatctgcatcttatcaaccaaactgttttgcctatccaccctgtggtgcccaagctgtacactcttttgtcctcaataccttcctccacaactcactattccgtgcttgatcttaaagatgcttttttcactattcccctgcacccctcgtcccagcctctcttcgctttcacttagactgaccctgacacccattaggctctgcaaattacctaggctgtactgccgcaaggcttcatagacagcccccattacttcagtcaagcccaaatttcatcctcatctgttacctatctcgccataattctcataaaaacacacgtgctctccctgctgatcatgtccgattaatctcccaaacctcaatcccttacaaaacaacaactcctttccttcctaggcatagttag

SEQ ID NO: 5 - DNA, 5711 bp, Homo sapiens
gtcaggcctctgagcccaagccaagccatcacatcccctgtgacttgcacggatatgaccagatggcctgaagtaactgaagaatcacaaaagaagtgaaaaggccctgccccgccttaactgatgacattccaccattgtgatttgttcctgccccaccttaactgagtgattaaccctgtgaatttccttctccaggctcagaagctcccccactgagcaccttgtgacccccgcccctgcccaccagagaacaaccccctttgactgtaattttccattgccttcccaaatcctataaaacggccccatccctatctcccttcactgactctcttttcggactcagcccgcctgcacccacgtgaaataaacagccatgttgctcacacaaagcctgtttggtggtctcttcacacggacacgcatgaaatttggtgctgtgactcagatcgggggacctcccttaggagatcaatcccctgtcctcctgctttttgctccataagatccacctaggacctcaggtcctcagatcgaccagcccaagaaacatctcaccaatttcaaatccggtaagcggcctctttttactctcttctccaacctccctcactatccctcaacctctttctcctttcaatcttggaaccacacttcaatctctcccttctcttaatttcaattcctttcattttctggtagagacaaaggagacacgttttatccatggacccaaaactccagcgctggtcacggactagggaaggcagcctttccttggtgtttaatcattgcagggacgcctctctgattattcacctatgtttcaaaggtgtcagaagacacagggatgcctgccttggtccttcacccttagcggcaagtcccgcttttctggggaaggggcaagtaccccaaccccttctctccttgtctctatctcttctctgcttttctgggggaggggcaagtacccttcaaccccatctccttcactgttagtggcaagtcccacttttctagaggggtaagtaccccagcctcgtatctctgcgccccaatcccttatttccatgccccgaccccttatttccgtgccctgaccccttatttccatgccctgaccccttatttctgtgccccatcccttatttccatgccccgacctcttatctctgagccccaaccacttttcccacttttctagaaggtaagaacccccaaaccccttccctccatttctctactctctctttcctctaggcttgcttccttcgctataggcaaccttccaccctccattcctccttctactcccttggcctgtgttctcaaaaacttaagacctcttcaactcacacccgacctaaaacctaaatgtcttattttcttctgcaatgccgcttgaccccaatataaacttgacagtagttccaaatagccagaaaacggcactttcaatttttccatcctacaggatctaaataattcttgttttaaaataggcaaatggtctgaggtgcctgacatccaggcattcttttacacatcagtcccttcctagtctctgtgcccagtgcaactcctcccaaatcttccttctttccctcctgcctgtcccctcagtcccaaccccaagcgtcactgagtctttctaatcttccttttctacagacccatctgacctctcccctcctcgccaggctgagctaggtcccaattcttccaccctataatctctttatcgcctcccctcctcacacctggtccagcttacagtttctttccgtgactagccctcccccacctgcccagcaatttactcttaaaaaggtggctggagccaaaggcatagtcaaggttaatgctcctttctctttatcccaaatcagatagcgtttaggctctttttcatcaaatataaaaatccagcccagttcatgactcgtttggcagcaaccctgagaagctttacagccctagaccctaaaaggtcaaaaggccatcttattctcaatatacattttattacccaatctgctcccgacattaaataaaactccaaaaattagaatctggccgtcaaaccccacaacaggacttgattaacctcaccttcaaggtgtacaataatagaaaaaacttgcaattccttgcctccactgtgagacaaaccccagccacatctccagcacacaagaacttccaaatgcctgactgaactgcagcagccaggcattcctccagaacctcctcccccaggagcttgctacaagtgccagtaatctgaccaccaggccaaggaatgcctgcagcccaggattcctcctaagctgtgtcccatctgtgcaggaccccactggaaatcggactgttcaactcacctggcagccactcccagagcccctggaactctggcccaaggctctctgactgactccttcttggcttaatggctaaagactgatgctgcccgatcgcctcggaagcccctagaccatcacggatgccgagcttcaggtaactctcacagtggaaggtaagcccgtccccttcttaatcaatacggaggctacccactccacattaccttcttttcaagggcctgtttcccttgcctccataactgttgtaggtattgacagccaggcttctaaacttcttaaaactccccaactctggtgccaactgagacaatactcttttatgcactcttttttagttatccccacctgcccagttcccttattaggctgagatattttaaccaaattatctgcttccctgactattcctggactatagccgcatctcattgctgcccttcttcccaatccaaagcctcctttgcatcctcctcttgtattcccccaccttaacccacaagtataaaatacctctactccttccttcgggactgatcatgcaccccttaccatctcattaaaacctaatcacccttaccccgctcaacaccaatatcccatcccacagcatgctgtaaaaggattaaaacctgttatcactcgcctgctacagcatgggcttctaaaacctataaactctccttaccattcccccattttacctgtcctaaaaccagacaagccttacaagttagttcagaatctgtgccttatcaaccaaattgttttgcctatccaccccatggtgccaaacccatatactctcctatcctcaatagctccctctactacccattattctgttctggatctcaaacatgctttctttactattcctttgcacccttcatcccagcctctctttgtcttcacttagactgaccctgacacccattaggctcagcaaattacctgggctgtactgccacaaggcttcacagacagcccccattacttcagtcaagtccaaattttatcctcacctgttacctatctcggcataattctcataaaaacacacgtgctctccctgctgatcatgtccaattaatctcccaaacctcaatcccttacaaaagaacaaccctttccttcctaggcatggttagtgcggtcagaattcttacacaagagccaggaccacaccctgtagcctttctgtccaaataacttgaccttactgttttagcctagccctcaggtctgcgtgcagaggctgccactgctttaatactgttagaggccctaaaaatcacaaactatgctcaactcactctctacatttctcataacttccaaaatctattttcttcctcataactgacgcatatactttctgctccccggctccttcagctgtactcactctttaagtcccacaattaccattgttcctggcccagacttcaaactggcctcccacattattcctgataccacacctgacccccatgactgtatctctctgatccacctgatattcaccccatttccccatatttccttctttcctgttcctcaccctgatcatgcttgatttattgatggcagttctaccaggccttatcgccacacaccagcaaaggcaggctatgctatagtacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgctcccacccaggactggcaaattagctttactcaacatgtccggagtcagataactaaaatacctcttagtctaggtagacactttcactggacaggtagagtcctttcctacagggtctgagaaggccaccgcagtcatttcttccgttctgtcagacataattcctccgtttagccttcccacctcaatacagtctgataacagaccagcctttattagtcaaatcagccaagcagtttttcaggctcttagtattcagtgaaaccattatatcccttaccgtcctccgtctacaagaaaagtagaacggactaaaggtcttttaaaaacgcacctcaccaagctcagccaccaacttaaagaggactggacaatacttttaccactttcgcttctcagaattcaggcctgtcctcagaatgctacaaggtacagccaatttaagctcctgtatagacgctcctttttattaggccccagtctcattcgacaccagaccaacttagactgtgccccaaaaaaacttgtcatccctactatcttctgtctagtcatactcctattcaccattctcagctactcatacatgccctgctcttgttgacactgccggtttacactgtttctccaagccatcacagctgatatctcctggtgctatccccaaactgccactctaaactcttgaagtaaataagtaatctttgctggcaggactatgctgaatctccttaggcactctctaatcagatgtcctaggtcctcccaattcttagaccttttatacctgtttttctccttttgttattccatttagtttttcagttcatacaaaaccgtatccaggccatcaccaataattctacacgacaaatgtgtttcttctagcatccccacaatatcaccccttaccacaaatcttccttcagcttaatctctcccactctaggttcccacgccgcccctaatcccgcttgaagcagccctgagaaacatcgtccactctctctccataccacccccaaaaattttcaccgccccaacacttcaacactattttatttttcttattaagaaggcaggaatgtcaggcctctgagcccaagccaagccatcacatcccctgtgacttgcacggaaaggaccagaaggcctgaagtaactgaagaatcacaaaagaagtgaaaaggccctgccccgccttaactgatgacattccaccattgtgatttgttcctaccccaccttaactgagtgattaaccctgtgaatttccttcttctggctcagaagctcccccactgagcaccttgtgacccccgcccctgcccaccagagaacaaccccctttgactgtaattttccattaccttcccaaatcctataaaacagccccacccctatctcccttcactgactctcttttcggactcagcccgcctgcacccaggtgaaataaacagccatgttgctcacacaaagcctgtttggtggtctcttcacatggatgcgcatgaaa

SEQ ID NO: 6 - DNA, 1177 bp, Homo sapiens
aaaaagacaggaattgctcactcagggagctcggctcttgagacaggagtcttgctgatgcccctggccgaataaaccccttccttctttaactcagtgtctgaggagttttctgcgcctcgtcctgctacatttcttggttccctgatggggaagcgaggtgaatggcggatggtcgaggcagctccttaggcggcttaagcctgccgtgtggaacatccctgcgggcgactctaactagcccgggcgacgcggatcctgagagtgctccctggtaggcatttgccccaggaggacgcttcgccagagcagtgtgtggcaggcccctgtggaggatcaacacagtggctgaacaccaggaaggaacgggcacttagagtctggacatctaaaacttggtaagactagtctttgaaacttgcccactccaggccaggtgtggtgcctcaggcctgtaatcccagcactttgggaggccaaggcgggcggatgacgaggtcaggagatcgagaccatcctggctaacacggtgaaaccccttctctactaaaaatacaaaaaaattagctgggcgtggtggtgggtgcctgtagtccccaccagagcgagactccgtctcaaaaaaaaaaaaaaaagaaacttgcccactgcatttaagtggaagcgtggcctgatcacccatggtgtgcctgtaccggcactttagtttttgtttttgacttgacttagattgcttaatactctggttttggttttgacctaacttagatttctagatactctgattttagttttgattttagtttggtgcaaactgcgaaagtgtgtgtgtgccctttttacctgttctttgttttgtggtgtgcgtgtggtgtgagtgtggtgttttgtgtcgaagaagcataggtcaggcacaaataagcccaccctgctaggaactatgttgaaaaatttcaaaaaagaatttaaaggagactatagagtactatgacacgaggaaaacttaaaactttgtgtaagatagactggccagcattagaggtaggttggccattagaaaaaagcctggacaggtcccttgtttcaaaggtatggcacaaagtaacctgtaagccagggaacccagaccagttcccgtacatagacacttggttacagctagttttagaccccccgc

SEQ ID NO: 7 - DNA, 5409 bp, Homo sapiens
gtaggagagcggtcagggtgatgggagaaattacagggaaagacacaaacgttcttggaaggctgggaggttttgcaaagcttcgaaagaaaatttggctgaaggcagccaaattctcttattcggagcctgagagcaaagggtagataacaagggaatataaaggaactaacctagataaatttgtttactcctgtctccagaaacaaacctttgatcattcacacacaggactggtctctacttgggggggtgacaatgtttattacccacaaattgtgtttgccccaagcctttgtcattaaatctgtactaaataaatgtgagtgtcaccagcttagtggggctgcgaactctcttcggcccctagtgctggtagttccctatcccgctctttcactggatacctatgtctgagtactcctttcattcatcgctgggctagagtctgagggacagacttagcaggtggtgccccatgtgagaagtgctgcaatggattgcaatggaaccctcgaaaacgaaggtgaagagactgtgcggtcagtaagtcagtaagtcattggtgcccacttgggatttccaaattcaagggaattgttcatgctagggtttcatcatggacaacagttatcagctcaacagcaacagtatataaaagtattgaaacagctgcttaaagctagcagaacctcggtttcacaggctcaattaagggacctaatgcaaactgttgtttcccctaacccatttttcccagaagaaggcatgctagacatagagctctgggaacaagtggggagaaatcttaaacaacattatgcacaagggcaacaggtcccagtaacatctctaacgttatgggccttagtcagggctgctttggctctgctctacacagaagagcctcaaaagggaagggaggagaaacagtcaccttcctatctgcctccctctacctcagccccgctatcactgggaaaaaatacctgagccccccctccaataaattgttttttttttttttgagatggagttttcgctcttgtcgcccaggctggagtgcaacggcgcgatctcggctcaccgcaacctctgcctcccgggttcaagcgattcttctgcctcagcctcccaagtaacggattacaggcatgcgcctccacgcctggctagttttgtatttttagtagagatggggtttctccatgttggtcaggctggtctcaaactcctgacctcaggtgatccgtccgcctcggcctcccaaagtgctaggattacagatgtgagccactccgcccagcctcctataaattgttaaaaagacaagggatatgctacagttatgggaccctatcttaggcaagcggcattagaaggggagctcttagcctgcctggtaatgcaagatcgacaaggcaatcaggtacatgaacccctttcttttgatgcttgtaaagagataagaaaaagcattagagaaaacggagccgctatcccatttacaaaaggattaattgagtccatagcagacaacttccgtatgactccatgggactggtcaatgctagcaaaaacaactttaaacaccagtcaataccccctctggagggcagaatttgatgaataatgtaaacaaccaacccttttctagtaatggccactgttattcctcccctacccctaacatggctctctcaaaatcctatttgggtagaacagtagcctttaaagggagagaaattataaggagtccattaattagttgaggaacaattaaaagccggccatatagaaccatcaaacagcccttggaattcacccatttttgtcattcccaaaaggtctggcaaacggagacttttgcatgacttacgggctatcaatgctaatttgcaacctatggggccccttcaacagggcctcccccatggtaattcctcaagattggcctatagtcgttattgacttaaaagactgcttttattttttattttttttattttttttattttttgagacggagtctcgctctgttgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcatgagccaccgcgcccggccaagactgcttttatactattccccttgcagaacaggacagagaaaaatttgtatttacaataccagctatcaataatgaaaggccagctcacaaatctcattggaaagttcctcctcaaggaatgctgaacagtcctagcccactctttcactggatacctgtgtctggatatgtctgtatcatataaatcaggctttgctccccaatagaaaagaatttcctaattgcaagattattcattttatggatcatattttactagcagccccaatggagccaatgcttttcagtttctatgcctctgtcataaagaatacacagttaagaggtttaatcatagcacctgaaaaagtacagttgtcctctccttggaagtatcttggatacatactaacttctcggtcagtaagatgtcaaaaggttaaattaaatattagcaacttacacaccttaaatgattatcaaaaaatactgggtggtattaatttgcttcaccccatcttgggcataactactgataagttacaaaacctgttttctatcctaaagggcaatacagccctagactctcccaggtatttaactcctgcagcaaaaagggaaattgaggaaatagagcaagctatttctcagaggcagctagatcacatagacccatgatattcagttctattgtttgtttttcctactaagcattccccaacagaattaataggacagatggccccagggctatgctttctagaatgggttttttgctcacataccgggactaaaacactatctccctatatccagctagttattgaagtcacctacacaagctgcagatgatgcaatcagttgctaggttatgaccctgatgtcataagaattcctttgagtaaaaagcaatttgaagcagcattgccccatctctaaatcttcagataacactttctaattatgtaggccatatagagcatgcctttactgctgacaaactcattcagttcttatcttgtactcctgtaattgtgcctacaaaagtaggcacatacctaacactttaatgctttttactgacggctctggtaaaaatggaaaagtggctatttggtggagaccacataattccctcacttgttctggatttactagcactcagagagctggggttgaagccttaatattggcctggagaacttttccactcagcctatcaatattgttggtgactttgcttactctgtttattgcagaaccttgaaacaggcctcattaagtctactgtcgagcccaccgtgtgcacgttttcttcaacttcagcaattgctggatcaacgtacacaccctatttttatcatacactattcaagcccacagctcactgcctggcccactggcttatggcaataatcaagcagacctgcaagttatgatgtcactgcttgaccaaaccacataatcacatcaatttttccaccaaaattggaggaacttaacaatttcaacttaaccaaagactagataaacaaattatcctgcagtgcccagattgccagctcacaggcacgtcccctcctttaacaggtattaaccctagggactagaacctaatcagttatagcaaagagatgttactcaagtccctgaatttggaaaactaagatatgtacatgcatccgttgataccagttctcacttaattagtgctcatgctcttcctggagagtccacctggtatgtcattaaacatcttcttttaacctttgcacttatggggtgacccacaaaaattaaaactgataatggtctggcttatgctagttcacaatttcaacaattttgttatacatggaatatccagcattccacaggcatccgtataacccccaaggataggccatagtagaatgtgtccattcctctcttaaaaatatgctcagaaaaccaaaaaggggaattatgagtaaggaccctgcaacactactagcacaagccttatttacccttaatttcttaaatttaaatgataaatttcaatcagctatagaaaagcactttgctaaaacctctcgagacataaaacccacagttttatggaaagatgtaaatagtaatgtatggtgtggtccaaatgatttgctaacgtgaggaagaggatatgcttgtgttcacacccccctcaggtcctctttggattccagcacaatgcatcaaaccttaccagagtgtgggtagaacctaacccggtaataaagaaaataatcctgcaggactcagccctggacaatgtggcttcctcagacaacacaggccccagactgaatgctaaagaagacaactcaggaggctaagcgaatcctgctccaaacacaaacatgttcactccaaataatttgttccttttttattctctcactttgcctactacctgtacctgctacactctattaggcccatcttctaattctgcctttcttccaccctgttacttagacaaacacccccttcccagcttctaataaagcaactgctaggctagaagggattgacttaccccaagtggggttcctcagtaatggcacacattagactgaggtgctaggtaacactacatgtcactccttgattggaaaggaatgttactgattatactcaggtttgtcttacgttatttactaattctaggatgcaaagccaaaatacaagcagtgaccgctacgcctgacaaacctgttgctgcacacatctgtactcttcaatcaacaaaacctgatgcaaaaaacagaaaagggggagatgtaggaaattggtcagggtggtggaagaaattatagggaaagacacaaaccttcttggaaggccgggaggttttgcaaaagcttcgaaataaaatttggctgaaggcagccaaattctcttatccagagcctgagagcaaagggtagataacaagggaatgtaaaggaacttatctagataaatttgtttactcctgtctgcagaaaccaacctttgatcattcgcctgcaggactgctctctacttggggggtcgacaatgtttattacccacaaattgtgtttgctccaagcccttgtcgttaaatctgtactaaata

SEQ ID NO: 8 - DNA, 8131 bp, Homo sapiens
atggaatgagaccaccacttctcctgttgtccttcccagcttctccccaacctccccttttccctagtttataagacaggagaaaagggagaaagcaaaaagctggaaagaaacagaagtaagataaatagctagacgaccttggcgccaccacctggccctggtggttaaaatgataataatattaacccctgaccaaaacgactggtgttatctgtaaatcccagacattgtgtgagaaagcaccgtaaaactttttgtcctattagctgatgtgtgtagcccccagtcacgttcctcacgcttacttgatctattatgaccctttcacgtggaccccttagagttgtaagctcttaaaagggctaggaatttctttttcggggagctcggctcttaagacgcgagtctgccgacgctcccggccgaataaaaacctcttccttctttaatccggtgtctgaggagttttgtctgggactcatcctgctacatttcttggttccctgaccgggaagcgaggtaattgacggacggtcgaggcggccccttaggcggcttaggcctgccctgtggagcatccctgcgggggactgtggccagcttgagctacgcagatcctgagagcactcccgggtaggcaatgctcttgacgggtggaacacctcgtcagagcagtgtgtggcaggcccccgtggaggatcagcacagtggctgaaggaacgggcacttggagcccggacatctgaaacttggtaagactggtctttggaacttgcccactccatttgagtggaagcatgtcctgatcacccacggtgtgcctgtaccggcactttggtttttgtttttgacttgacttgaattgcttgatactttggttttggttttgacctggcttggatttctggatactctgggtttggttttgattctggtttggtgtaaactgaaaaagtgtgtgtgtgccctttttacccattctttgttctgtggtgtgcgtgcggtgtgagcttggtgttttgtctcaaggaaacacgggtcagacacaaggtaagcctactccgctaggaactatgttgaaaaattttaagaagggatttaacggagactatggggttactatgacaccagggaaacagaattttgtgtgaaatagatcggccaacattagaagtgggttggccatcagaaggaagcctggacaggtcccttatttctaaggtatggcacaaggtaactggtaagtcaggacactcagaccagttcccatacatagacacttggttactacagctggtgcaagaccccccacagtggctaagagggcaggcagcagcagtgctagtagcaaagggacagatagccaaggaaggatcccgctctacccactgggggaaatcaactcctgaagttctgttcgacccaacatcagaagatccattgcaggagatggcaccagtgatcccagtgctgccctccccttaccaggcagagaggctccctacttttgagcccacagtgcttgtgcctccgtaagacaaacatatccctaggccacccagagtagacaagagaggaggtgaagcctcaggagaaacccctcccttggcagcttgtttaagacccaaaactgggatacaaatgcccctgagagagcagcggtatactgggatagaggaggatggtcacatggtggagaagcgtgtttttgtgtaccagcccttcacctctgccaaccttctcaattggaaaaacaataccctgtcctatactgaaaaaccacaagctctaattgatttgctccaaactattatccagacccataactccacttgagctgattgccaccagttgctcatgttcctctttaacacagatgaaaggcagagagtgctccaagcagcaactaagtgggtacaggaacatgcaccggctgattaccaaaacccccaagagtgtgtaaggacccagttaccaggaactgacccccagtgggatccaaatgaaagagaggatatgcaaaggctaaaccgagacagggaagctgtcttggaaggattaaagaggggagcccagaaggccacaaacgttaacaaggtctctgaggtcattcggggaaaaagaagaaagtccagcacaattctaccagagactgtgtgagggctatcgtatgtatactccctttgatcccgttagccctgaaaatcagcgaatggttaacatggctttagttagtcaaagcgcagaagacattagaagaaaactgcagaaacaggatgggtttgcagggacgaacacatcacagttattagaagtagctaaccaggtgtttgtaaacagggatgcagtaagccctaaggaaaaccgcagagagaatgaacgtcaggcccggcgaaacgccgagctgttagctgcagcagtcggaggggtctcctcaaagaggcaagggaaggggggacccgggaaagagactcagcctggctgtcagagcttgcagtgtaaccagtgtgcttattgtaaagaaataggatattggaagaacaaatgcccccagctaaaaggaaaacaaggtgacttggagcaggaggttccagacaaggaggaaggggccctgctcaacctggcagaagagttattggactgagggggaccgggctcaagggcccccaaagagcctatggccaggatgacagtcgggggtaaagacattgattttcttgtagatactggtgctgaacattcagtagtaaccgccccggtcgcccccttctccaaaaagactattgacataatcagagccatgggaatttcagcaaaacaagctttctgcttgccccggacttgtactgtaggaggacgtaaagtgattcatcagtttttatatatgcctgactgtcccttgcccttgttgggaagggacttgctttgcaagctgagagccactatctcttttacagagcatggctctttgctgctaaagttacctggaacgggagtcattatgacccttacggtcccctgagaggaggaatggagacttttcttaactgagtcaggccaagagataagaccagctctggctaagcggtggccaagagtgtgggcggaagacaaccctccagggttggcagtcaaccaagcccccatacttatagaagttaagcctggggcccagccagttaggcaaaaacagtacccggtccccagagaagctcttgaaggtattcaggtccctctcaagtgcctaagaacctttggaatgatagttccttgtcagtctccatggaacactcccctcctgcctgttcccgagcctaagaccaaggactactggccgggacaggatttgcgcttggttaagcaggctacagtgactttacatccagcagtacctaacccgtacacattgctggggttgctgccagctgaggacagctgcttcacctgcttggacctgaaagatgctttctttagcatcagattcgcccctgagagccagaagctgtttgcctttcagtgggaagatccggagtcaggtgtcactactcagtacacttggacctggcttcctcaagggttcaagaactcccccaccatcttcggggaggagttggctcgagacctccagaagtgtcccaccagaaacctaggctgcgtgttgctccagtacgttgatgaccttttgctgggacaccccacggcagtcgggtgcgccaagggaacggatgctctactccggcatctggaggactgtgggtataaggtgtccaagaaaaaagctcagatctgccgaccgcaggtacgttacttgggatttactatccgacagggggagcgcagcctgggatcagaaagaaagcaggtcatttgcactctaccggagcctaagagcagaaagcaggtgagaaaattcttaggagctgcggggttttgcagactgtggatcccaaactttgcagtattagccaagcctttgtatgaggtcacaaagtagggggaccgggaacctttcgaatggggatcccaacaacagcaagcctttcgtgagttaaaggaaaaacttatgtcagccccagccctggggctacccaatctgacaaagccttttacattgtatgtgtcagagagagaaaagatggcagttagagttttaacccaaactgtggggccctggccgaggccagtggcctacctctctaaacaactagatggggtttctaaaggatggcccccatgtttgagggccttggcagcaactgccctgctagtacaagaagcagttaagctgactcttgggcaaaacctgaacataaaggccccccatgctatggtgactttaataaatactaaaggacatcattggctaacaaatgctagactcaccaagtaccaaagtttgctctgtgaaaatccccgtataaccattgaaatttgtaacaccctgaaccccactaccttgcttctggtatcagagggccctgtcgagcatgactgtgtagaagtgttggactcagtctactctagcagacctgacctccaggaccagccttgggcaccagtagactgggaactatacatggatgggggcagcttcatcaacccacaaggagagagaggtgcagggtatgcagtggtaaccctggacactgttgttgaagccaggtcgttgccccaggccacttcacccagaaagctgaactcattgctttcattcgggccttagaactcagtgaaggtgagactgtaaacatttacactgactctcggtatccctttttaacccttcaagtgcatgaagcatcatataaagaaaagggcctattgaactctgggggaaaggacataaaatatcaacaagaaatcttgcaattattagaagccgtatggaaaccccacaaggtggcagttatgcattgcagaggacaccagcgagcttccaccttggtgggcttggggaattcccgtgctgactcagagttccggaaaggtagagcagatgaattggactatcaaaaatagttaagggaaagtatgtcaggaaacaggattaaaatggatacaggctctccctatggtattatttaaaattagatgtaccccttctaaaagaacaggatattccccttatgaaatattataggccccctcccatattgcggggacttccaggcactccccgagagttaggtgaaattgagttacagcgacagctacaggctttaggaaaaattacacaaacaatctcagcctgggtaaatgagagatgccctgttagcttattctccccagttcaccctttctccccaaggactggaacgtagcctctttgtgcccacggtggaaaggaccccagactgtcatcctgaccactcccaccgctgtgaaggtagaaggagtcccagcctggatccaccacagccgtgtaaaacctgcagtgcctgaaacctcagaggtaagaccaagcccagaggacccttgcagagtgaccctgaagaaaacgacaagccctgctccagtcacgcccggaagctgactggtccacgcacggccaaagcatgaggaagctcatcgtgggattcatttttcttacattttggacttacacagtaagggcttcaactgaccttactcaaagtggggactgttcccagtgtattcaccaggtcactgacgtaggacagcaaattaaaacaatctttctgttctatagttattatgaatgtatgggcacgttaaaagaaacttgattgtataatgcaactcagtacaaggtatgtagcccgggaaatgaccaacctgatgtgtgttataacccatctgagccccctgtaaccactgtttttgacagaagattaagaactggccttttcccaggtgatacaagtaaaataataactagaacagaagaaaaaggaatccccaaacaagtaactttaagatttgatgcttatgcagccattaatagtaacaagctaggaacaggatgtggttctcttaactgggaaaggagctacagagtagaaaataaatatgtttgtcatgagtcaggggtttgtgaaaattgtgccttttggccatgtgttatttgggctacttggaaaaagaacaaaaaggacctggttcatcttcagaagggggacgccaacccctcctgtgctgccggtcactgtaacccactagaactaataattaccaatcccctagatccccgttggaaaaagggagaacgtgtaaccctggggatcgatgggacagggataaacccccaagttgccattttagttagaggggaggtccacaagcactctcccaaaccagtgtttcaaaccttttatgaggagctgaatctgccagcaccagaacttccgaaaaagacaaaaaatttgtttctccaattagcagaaaatgtagctctttcccttaatgttacttcctgttatgtatgcaggggaaccactatcggagaccgatggccttgggaagcccgagagttggtgcctactgatccagctcctgatataattccagttcagaaggcccaagctagcaacttctgggtcctaaaatcctaattattggacaatactgtatagctagagaagggaaagactttatcgtccctgtagaaaagcttaattgtataggacagaagttgtacaacagcacaacaaagacaattacttggtggggcctaaaccacactgaaaagaacccatttagtaaattttctaaattaaaaactgcctgggctcatccagaatctcatcaggactggacggctcccaccggactataccggatatgtgggcacacagcctacattcagttacctaataaatgggcaggcagttgtgttattggcactattaagctgtcctttttcttattacccataaaaacgggtgagctcctaggtttccgtgtctatacctcccgagaaaagagaggcatagttataggaaactggaaagataatgagtggccccctgaaaggatcatacaatattatgggcctgccacatgggtacaagacggctcatggggataccaaacccccatctacatgctcaatcagatcatacggttgcagaccgtcttagaaataattactaatgaaactggcagagctttgactgttttagctcggcaggaaacccaaatgaggaatgctatctatcagaatagactggccttggactacttgctggcagctgaaggaggagtttgtggaaaatttaacttaaccaattgctgcctacaaatagatgatcaaggacaggtgattgaaaacatagtcagggacatgacaaagttggcacacacgcctatacaggtttggcacaagtttgatcctgagtctttatttggaaaatggtttccagctataggaggatttaaaaccctcattgtaggtgtattgctagtaataagaacttgcttgctgctcccctgtgtattacccttgctttttcaaatgataaaaggtattgttgctactttggttcatcagaaaacttcagcacacgtgaattatatgaatcactatcgctctatctcgcaaagagactcaaaaagtgaggatgagagtgagaactcccactaaaaagtgaaaattctcaaaggggggaaatagggaatgagaccaccacttctcctgttgtccttcccagcttctccccaacctccccttttccctagtttataagacgggagaaaagggagaaagcaaaaagctggaaagaaacagaagtaagataaatagctagacgaccttggcgccaccacctggccctggtggttagaatgataataataatattaacccctgaccaaaacgactggtgttatccgtaaattccagacattgtgtgagaaagcaccgtaaaactttttgtcctgttagctgatgtgtgtagcccccagtcacgttcctcacgcttacttgatctattatgaccctttcacgtggaccccttagagttgtaagctcttaaaagggctaggagtttctttctcggggagctcggctcttaagacgcgagtctgctgacgctcccggccgaataaaaacctcttccttctttaatctggtgtctgaggagttttgtctgcgactcatcctgctaca

SEQ ID NO: 9 - DNA, 327 bp, Homo sapiens
tgggtcaggcacaaagtaagcccaccccaccaggaactatgttgaaaaatttcaagaaaggatttaagggagattatggtgttactctgacaccaggaaaagttagaactttatgtgaaatagactggccagcattagaggtggatttcccatcagaagtaagccttgacgggtccgttgtttcaaaggtatggcacaaggtaacctgtaagccagggcacgcaaaccagttcctgtacatagacacttggttacagctggttttagatccgcctcacagtggttgagagaacagcagcataagcagctgacagaggcaaggaaaga

SEQ ID NO: 10 - DNA, 5841 bp, Homo sapiens
gtcaggcctctgagcccaagcccagccatcgcatcccctgtgacttgcacatatatgcccagatggcctgaagtaactgaagaatcacaaaagaagtgaatatgccctgccgcaccttaactgatgacattccaccacaaaagaagtgtaaacggccggtccttgtcttaagtgatgacattaccttgtgaaagtccttttccgagctcatcctggctcaaaaagcacccccactgagcaccttgggacccccgcccctgcccaccagagaacaaccccctttgactgtaattttcctttaccttcccaaatcctataaaacggccgcacccctatctcccttggctgactctcatttcggactcagcccgcctgcacccaggtgaaataaacagccatgttgctcacacaaagcctgtttggtggtctcttcacacggacacgcatgaaatttggtgccatgactcgaattgggggacctcccttgggagatcaatcccctgtactgctgttctttgctccatgagaaagatccacctacgacctcaggtcctcagaccgaccagcccaaggaacatctcaccaattttaaatcaggttagcggcctcttcttactctcttctccagcctctctctgtccctcaaccacactttctcctttccactcttcaatctctcccttctcttaatttcaattcctttcattttctgagacagacaaaggagacacgttttatccgtggacacaaaactctggcgccggtcacggactgggaaggcagctttcccttggtgtttaatcattgcagggacacctctctgattatacacccacgtttcaagggtgtcagaccacgcagggacgcctgccttggtccttcacccttagcggcaagtcccacttttctggggaaggtgcaagtacctcaaccccttctctccttgtccctacccattctctgcttttccggggacagggcaagtaccccaaccccttctctccttgtctctacccttctctgcttttctgggagaggggcaagtacctcaaccccttctctccgtgtctctaccccttctctgctttcctggggcaggggtaagtacccctcaaccccttctccttcacccttagcggcaaatcccactttcctagggggaaagaaccccccaatcgcttatttccgcaccccaacctcttatctctgcaccccaataccttatttccgcaccctgacctcttatctctgtgcctcaatcccttatttccgtgccccaaccccttctctgcttttctggagggcaggaacccctcaccccttctccgtgtctctactcttttctctgggcttgcctccttcactataggtaagcttccaccttccattcctccttcttctcccttggcctgtgttctcaaaaacttaaaatctcttcaactcacacctgacctaaaacctaaatgccttattttcttctgcaatgccgcttgaccccaatacaaactcgacagtagttccaaatagccagaaaatggcactttcaatttttccatcctacaagatctaaataattcttgtcataaaatgggcaaatggtctgaggtgcctgacgtccaggcattcttttacacatcagtcccttcctagtctctgtgtccagtgcaactcatcccaaatcttccttctttccattctgcctgtccccttagtcccaaccccaagcgtcactgagtctttctaatcttccttttctacagacccatctgacctcttccctcctcgccagcccaagctacgtcccaattcttcctcagcctccgctcctccaccctataatctttttatcacctcccctcctcacacctggtccggcttacagtttcgttccgtgactagccctcccccacctgcccagcaatttactcttaaaaaggtggctggagccaaagacatagtcaaggttaatgctcctttttctttatcccaaatcagatagcatttaggctttttcatcaaatataaaaacccagcccagttaatggctcgttcggcagcaaccctgagacactttacagccctagaccctaaaaggtcaaaaggccgtcttattctcaaaatacattttattacccaatctgctcccaacatcaaataaaacaccaaaaattaaattctggccctcaaaccccacaacaggatttaattaacctcatcttcaaggtgtacaataacagaaaaaagttgcaattccttgcctccactgtgagacaaaccccagccacatctccagcacacaagaacttccaaatgcctgacccacagcggccaggcattcctccagaacctcctcccccaggagcttgctacatgtgccggaaatctggccactgggccaaggaatgcccgcagcccgggattcctcctaagccgcgtcccctctgtgtgggaccccactgaaaatcggactgttcaactcacctgacagccactcccagagcccctggaactctggcccaaggctctctgactccttcccagatcttctcagcttagcggctgaagactgacactgcccgatcccctcggaagccccctaaaccatcatggacgccgagcttggggtaactctcacagtggaaggtaagcccgtccccttcttaatcaatacggaggctacccactccatattaccttcttttcaagggcctgtttcccttgcctccataactgttgtgggtattcacggccaggcttctaaacctcttgaaactccccaactctggtgctaacttggacaatactcttttaagcactcctttttagttatccccacctgcccagttcccttattaggctgagacactttaaattatctgcttccctgactattcctagactacagctatatctcatggccgccctttttcccaatccaaagcctcctttgcgtcctcctcttgtatccccccaccttaacccacaagtataagatacctctactccctccttggagaccgatcatgcaccccttaccatctcattaaaacctaatcacccttaccccactcaacaccaatatcccatcccacagcaggctttaaaaagattaaagcctgttatcactcgcctgctacagcatggtgttttaaagcctataaactctccttataattcccccattttacctgtcctaaaaccagacaagccttacaatttagttcaggatctgcaccttatcaaccaaattgttttgcctatccaccccgtggtgccaaacccatatactctcctatcctcaatacctgcctctacaacccattattctgttctggatctcaaacatgctttctttactattcctttgcatccttaatcccagcctctcttcgctttcacttggactgaccctgacacccatcaagctcagcaaattacctaggctgcactgccgcaaagcttcacaaacagcccccattacttcaatcaagcccaaatttcttcctcatctgttacctatctcggcataattctcataaaaacacatgtgctctccctgccaatcgtgtccaactgatctctcaaaccccagcaccttctacaaaaccacaactcctttccatcctaagcatggttagctcggtcagaattcttacacaagagccaggaccacaccctgtagcctttctgtccaaacaacttgaccttactgttttagcctagccctcatgtctgcgtgcagcagctgccactgctttaatacttttagaggccctcaaaatcacaaactgtgttcaactcactctctgcagttctcataacttccaaaatctattttcttcctcatacctgacgcatatactttctgcttcccggctccttcagctgtactcactgtttgttgagtctcccacaattaccattgttcctggcccatacttcaatccagcctcccacattattcctgataccacacctgacccccatgaccgtatctctctgatccacctgacattcacatttccccaaatttccttctttcctgttcctcaccctgatcacgcttgatttattgatggcggttccaccaggcctaatcgccacacaccagcaaaggcaggttatgctatagtacaagccactagcccgcctcttagaacctctcatttcctttccattgtggaaatctatcctcaaggaaataacttctcagtgttccatctgctattctactactcctcagggattattcaggccccctcccttccctacacatcaagctcgaggatttgccccacccaggactggcaaattagctttactcaacatgccccgagtcggataactaaaatacctcttagtctaggtagacactttcactggataggtagaggcctttcctacagggtctgagaaggccaccacagtcatttctacccttctgtcagacataattcctcagtttagccttcccatctcaatacagtctgataacagaccagcctttattagtcaaatcagccagcagtttttcaggctcttagtattcagtgaaacctttatatccctcacggtcctgcgtcttcaagaaaagtagaatagactaaaggtcttttaaaaacacacctcaccaagctcagccaccaacttaaaaaggactggacaatacttttaccactttcccttctcagaattcaggcctgtcctcagaatgctacagggtacagcccatttaagctcctgtatagacgctcctttttattaggccccagtctcattccagacaccagaccgactttgactgtgccccaaaaaaaattgtcatccctactatcttctgtctagtcatactcctattcaccgttctcaactactcatacatgccttgctcttgtttacactgccggtttacactgtttctccaagccatcacagctgatatctcctcctgctatccccaaactgccactcttaactcttgaagtaaataaataatctttgctggcaggactatgctgaatctccttaggcactctctaatcagatatcctgagtcatcccaattcttagaacttttatacctgtttttctccttctgttattccatttagtttttcaattcatccaaaaccgtatccaggccatcaccaatcattctatacgacaaatgtttcttctaacatccccacaatatcaccccttaccacaagacctcccttcagcttaatctctcccactctaggttcccacactgcccctaatcccgcttgaagcagctctgacaaacatcgcccattctctctccataccactccctaaaaattttcgctgccccaacacttcaacactattttgttttatttttcttattaatgtaagaagtcaggaatgtcaggcctctgagcccaagccaagccatcgcatcccctgtgacttgcacgtataagccccgatggcctgaagtaactgaagaatcacaaaagaagtgaatatgccctgccccaccttaactgatgacattccaccacaaaagaagtgtaaatggccgttccttgccttaagtgatgacattaccttgtgaaagtccttttcctagctcatcctggctcaaaaagctcccccactgagcaccttgggacccttgcccctgcccaccagagaacaaccccctttgactgtaattttcctttaccttcccaaatcctataaaatggccccacccctatctcccttggctgactctcatttcggactcagcccgcctgcatccaggtgaaataaacagccatgttgctcacacaaagcctgtttggtggtctcttcacacggacgcgcatgaaa

SEQ ID NO: 11 - DNA, 965 bp, Homo sapiens
gtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacaggtgtggaggggcaacccaccccttca

SEQ ID NO: 12 - DNA, 7232 bp, Homo sapiens
gacaggcctctgagcccaagccaagccatcacatcccctgtgacttgcatgtatatgcccagatggcctgaagtaactgaagaatcacaaaagaagtgaaaaggccctgccctgccttaactgatgacattccaccattgtgatttgttcctgccccaccttaactgagtgactaaccctgtgaatttccttctcctggctcagaagctcccccactgagcaccttgtgacccccgcccctgcccaccagaaaacaaccccctttgactgtaattttccattaccttcccaaaccctataaaatggccccacccctatctcccttcgctgactctcttttcggactcagcccacctgcacccaggtgaaataaacagccttgttgctcacacaaagcctgtttggtggtctcttcacacggacgcgcatgaaatttggtgccatgactcggatcgggggacctcccttgggagatcaatcccctgtcctcctgctctttgctccatgaaaaagatccacctatgacctcgagtcctcagacccaccagcctaaggaacatctcaccaattttaaattgggtaagcagcctcttcttactctcttctccaagctctctcactgtccctcaaccactttctcctttccactcttcaatctctcccttctcttaatttcaattcctttcattttctgggagagacaaaggagacatatttaatccatggacccaaaactccggcgctggtcatagactgggaagacagtcttcccttggtgtttaatcattgcagggatgcctctctgattaaacacacaggtttcaagggtgtcagaccacacagggacgcctgccttggtccttcacccttagcggcaagtcccgtttttctggggaaggggcaagtacctcaaccccttctctccttgtctctactccttctctgcttttctgggagaggggcaagtacccctcaaccccctctccttcacccttagcggcaagtcccacttttctatggggcaagaacccccaatcccttatttccatgccccaacctcttatctctgcaccacaatcccttatttctgtgccccaacctcttatctctgtgccccaatccctaatttctgcaccccgacctcttatctctgttccccatcccttatttctgcaccccaacctcgtatctctgtgccccaatcccttacttctgcaccccaacctcttatatctctgcactacaatcccttatttccatgccccaacctcttatctctgcaccccaatcccttatttctgtgccctgaccccttatttccatgccccgaccccttatttccgtgccccaatcccttatttctgcaccccatcctcttatctctgtgccccaatcgcttatttctgtgccccaacctcgtatctctgcaccccaatcccttatttccgcacactgacctcttatctctgtgccccaatcccttatttccatgccccaaccccttctgtgcttttctggagggcaagaaccccccaccccttctctgtgtctctactcttttctctgggcttgcctccttcactatgggtaagcttccaccttccattcctccttcttctcccttagcctgtgttctcaaaaacttaaaacctgttcaactcacacctgacctaaaacctaaatgccttattttcttctgcaatgccgcttgaccccaatacaaactcgacagtagttccaaatagccagaaaacagcaatttcaatttttccatcctacaagatctgaataattcttgtaaaataggcaaatggtctgagatgcctgatgtccaggcattcttttacacatcagtcccttcctagtctctgtgcccagtgcaactcatcccaaatcttccttctttcccccctgcctgtcccctcagtcccaaccccaagcgtcactgagtctttctaatattccttttctacaaacctatctgacctctcccctcctcgccaggctgagctaggtcccaattcttccaccctataatctttttatcacctcccctcctcacaactggtctggcttacagtttcgttccgtgactagccctcccccacctgcccagcaatttactcttaaaaaggtggctggagccaaaggcatagtcagggttaatgctcctttttctttatcccaaatcagaagcgtttaggctctttttcatcaaatataaaaatccagcccagttcatggctcatttggcagcaaccctgagacactttacaaccctaaaatgtcaaaaggccgtcttattctcaatatacattttattaaccaatctgctcccgaaattaaataaaactccaaaaattggaatctggccctcaaaccccacaacaagacttaattaacctcaccttcaaggtgtgcaataacagaaaatagttgcaattccttgcctccactgtgagacaaaccccagccacatctccagcacacaagaacttccaaacgcctgaactgcagcagccaggcgttcctccagaacctcctcccccaggagcttgctacaagtgccagaaatctgaccaccaggccaaggaatgcctgcagcccaggattcctcctaagccgtgtcccatctgtgcgggaccccactggaaatcggactgttcagctcacctggcagccactcccagagcccctggaactctggcccaaggctctctgactgactccttttgggcttagcggctgaagactgacgctgcctgatcacctcggaagccccatagaccatcacagacgccgagctttggataactctcacagtggaaggtaagtccgtccccttcttaatcaatacggaggctacccactccacattaccttcttttcaaggacctgtttcccttgcctccataactgttgtgggtattgacagccaggcttctaaacctcttaaaactccccaactctggtgccaacttagacaatactcttttatgcacccttttttagttatccccacctgcccagttcccttattaggccgagatattttaaccaaattatctgcttccctgactattcctggactatagccgcatctcattgctgcccttcttcccaatccaaagcctcctttgcgtccttctcttgtattcccccaccttaacccacaagtataagatacctctactccctccttggtgaccaatcatgcgccccttaccatctcattaaaacctaatcacccttaccccactcaatgccaatatcccatcccagagcacgctttaaaaggattaaagcctgttatcactcacctgctacagcatgggcttctaaaacctataaactctccttaccattcccccattttacctgtcctaaaaccagacaagccttacaagttagttcagaatctgtgccttatcaaccaaattgttttgcctatccaacccatggtgccaaacccatatactctcctatcctcaatacctccctctactacccattattctgttctggatctcaaacatgctttctttactattcctttgcacccttcaccccagcctctctttgccttcacttagtttgaccctgacacccattaggctcagcaaattacctgggctgcactgccgcaaggcttcacagacagcccccattacttcagccaagcccaaatttcatcctcatctgttacctatcttggcataattctcataaaaacacacgtgctctccctgctgatcatgtccgattaatctcccaaacctcaatcccttacaaaacaacaactcctttccttcctaggcatggttagtgtggtcagaattcttacacaagagccaggaccacaccgtgtagcctttctgtccaaacaacttgaccttactgttttagcctagccctcatgtctgtgtgcagcagctgctgctgctttaatactgttagaggccctaaaaatcacaaactatgctcaactcactctctacatttctcataacttccaaaatctattttcttcctcatacctgacacatatactttctgctccctggctccttcagctgtactcactatttaagtcccacaattaccattgttcctggcccggacttcaatctggcctctcacattattcctgataccacacctgacccccatgactgtatctctctgatccacctgatattcaccccatttccccatatttccttctttcctgttcctcaccctgatcatgcttgatttattgatggcagttccaccaggcctaatcgccacacaccagcaaaggcaggctatgctatagtacaagccactagcccacctctcagaacctctcatttcctttccatcatggaaatctatcctcgaggaaataacttctcagtgttccatctgctattctactactacacagggattattcaggccccctcccttccctacacataaagctcgaggatttgcccccacccaggactggcaaattagctttactcaacatgtcccgagtcaggaaactaaaatacctcttagtctaaatagacactttcactgaataagtaaagacctttcctacagggtctaagaaggccaccacagtcatttcttccctactgtcagacataattcctcagtttagccttcccacctctatacagtctgataacagaccagcctttattagtcaaatcagccaagcagtttttcaggctcttagtattcagtgaaacctttatatcccttacggtactccatcttcaagaaaagtagaacggactaaaggtcttttaaaaacacacctcaccaagctcagccaccaacttaaaaaggactggacaatacttttatcactttcgcttctcagaattcaggcctgtcctcagaatgctacaaggtacagcccatttgagctcctgtatagacgctccttttttttttttatttaagttttagggtacatttgcacattgtgcaggttagttacatatgtatacatgtgccatgctggtgcgctgcacccactaacttgtcatctagcattaggtatatctcccgatgctatccctcccccctccccccaccccacaacagtccccagagtgtgatgttccccttcctgtgtccatgtgatctcattgttcaattcccacctatgagtgagaatatgtggtgtttcgttttttgttcttgagatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcatgtgtgtgaataaacatacgtgtgcatgtgtctttatagcagcatgatttatagtcctttgggtatataaccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggatttgatttgcatttctctgatggccagtgatgatgagcattttttcatgtgtcttttggctgaataaatgtcttcttttgagaagtgtctgttcatgtccttcgcccactttttgatggggttgtttgtttttttcttgtaaatttgtttgagttctttatagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctggctagccatatgtagaaagctgaaactggatcccttccttacaccttatacaaaaatcaattcaagatggattaaagacttaaacgttagacctaaaaccataaaaaccctagaagacactcctttttattaggccccagtctcattcaacaccagaccaacttagactgtccctcaaaaaaacttgtcatccctactatcttttgtctagtcatactcctattcaccattctcaactactcatacatgccctgctcttatttacactgctggtttacactgtttctccaagccatcacagctgatatctcctggtgctatccccaaactgccactctaaactcttgaagtaaataaataatctttgctggcaggactatgctgaatctccttaggcactctctaatcagatgtcctaggtcctcccaattcttagaccttttatacctgtttttctccttctcttattccagtttttcaattcatacaaaactgtatccaggccatcaccagtcattctatacgacaaatgtttcttctgataaccccacaatatcaccccttaccacaagatcttcctttagcttaatctctcccactctaggtttccacaccgcccctaatcctgcttgaagcagccctgagaaacatcgtccattctctctccataccacccccaaaaattttcgccgccccaacacttcaacactattttgttttctttttcttattaatataagaaggcaggaatgtcaggcctctgagcccaagccaaaccatcgcatcccctgtgacttgcacgtatacgtccagatggcctgaagtaactgaagaatcacaaaagaagtgaaaaggccccgtcccgccttaactgatgacattccaccattgtgatttgttcctgccccaccttaactgagtgactaaacctgtgaatttccttctcctggctcagaagctcccccactgagcaccttgtgacccccacccctgcccatcagaaaacaaccccctttgactgtaattttccattaccttcccaaatcctataaaacggccccagcccatctcccttcactgactctctttttggactcagcctgcctgcacccaggtgaataaacagccttgtggctcacacaaagcctgtttggtggtctcttcacatggacgcgcatgaaa

SEQ ID NO: 13 - DNA, 5619 bp, Homo sapiens
gtcaggcctctgagcccaagctatgccatcatatcccctgtgacctgcacatacacatccagatggtcggttcctgccttaactgatgacattccaccacaaaagaagtgaaaatggccgttcctgccttaactgatgacattgtcttgtgaaattccttctcctggctcattctggctcaaaagctcccctactgagcaccttgtgacccccactctgcccgccagagaacaacccccctttaactgtaattttcctttacctacccaaatcctataaaatggccccacccctatgtcccttcgctgactctcttttcggactcagcccacctgcacccaggtgaaataaacagttttattgctgactcaaagcctgtttggtggtctcttcacacgaacgcgagtgaaatttggtgccgtgacttggatcgggggacctcccttgggagatcaatcccctgtcctcctgctctttgctccatgagaaagatccacctatgacctcaggtcctcagaccaaccagccaagaaacatctccccaatttcaaatccggtaagcagcctctttttactctcttctccaacctccctcactatccttcaacctctttctcctttcaatcttggagccacacttcaatctctcccttcttttaatttcaattcctttcattttctggtagagacaaaggagacacgttctatccgtggacccaaaactccggcgccggtcacagactgggaagacagacttcccttgatgtttaatcattgcagggacacctctctgattatttacccacgtttcagaggtgtcacaccattcagggatgcctgcctcggtccttcacccttagcagcaagtcctacttttctgtgggaggggcaagtaccccaaccccttctctccatgtttctaccccttctccacctttctagggggcaaggaacccccaaccccttctccttcacccttagcagcaagtcccgcttttctaggggaggggcaagtaccccaacctcttatatctctgtgccccaatcccttatttccatgccccgacctcgtatctctgtgccctgacccctttcccacttttctggagggtaagaacccgtgaaccccttccctccgtgtctctactctctcttttctctgggcttgcctccttcactatgggcaaccttccatcctccattcctcctccttctcccttagcctgtattcttaagaacttaaaacctcttcaactctcacctgacctaaaatctaagcatcttattttcttctgcaatgccgcttgaccccagtgcaaactcgacagttgctctaaatggccagaaaacggcactttcaatttctccatcctacaagacctaaataatttttgtcgaaaaatgggcaaatggtctgaggtgcctgacatccaggcattcttttacaaatcggtccctccctagtctctgtgcccagtgggactcgtcccaaatcttccttctttccctcctgcctgtcccctcagtcccaaccccaagcgtcgctgagtctttctaatcttccttttctacagacccacctgacctctcccctcctctccaggctgctccttgccaggccgagctaggttccaattcttcctcagcctgtctccaccctataatctttttatcacctcccctcctcacacctggtccggcttacagtttcgttcggtgactagccctcccccacctggccaggaatttactcttaaaaaggtggctggagctaaaggcatagtcaaggttaatagtcctttttctttatcccaaatcagacagcatttaggctctttttcatcaaatataaaaatccagcccagttcatgactcgtttggcagcaaccctgagacactttacagccctagaccctaaaagttcaaaaggccatcttagtctcaaaatacattttattacccaatctgctcccgacattaaatgaaactccaaaaattaaattctgaccctccaaccccacaacaggatttaattaaccttgccttcaaggtgtacaataatagaaaaaagttgcaattccttacctccactgtgagacaaaccccagccacatctccagcacataagaacttccaaacgcctgaatcgcagtggccaggcattcctccagaacctcctcccccaggagcttgctgcaagtgccagaaatctggccactgggctaaggaatgcctgcagcccaggattcctcctaagccatgtcccatctgtgtgggaccccactgaaaattggactgttcaactcacctggcagccacttccagagcccctgggactctggtccaaggctgtctgactgactcctgcccagatcttctcggcttagcagctgaagactgacactgcccgatcgcctcagaagcctacaggaccatcacagatgctctaggtaactcttacagtggagggtaagtccgtccccttcttaatcaatacggaggctactcactccacattaccttcttttcaagggcctgtttcccttgcttccataactgttgtgggtattgacggccaggcttctaaacctcttaaaactccccaactctggtgccaacttagacaatactcttttaagcactcctttttagttatccccacctgcccagttcccttattaggccgagacactttaactaaattatctgcttccctgactattcctaggctacagccacacctcattgccacctttttctccagttcaaagcctccttcacatcctccctttgtatctccccaccttaacccacaagtataagacacctctactccctccttggtggccaatcatgcaccccttaccatttcattaaaatctaatcacccttaccctgctcagtgccaagatcccatcccactgcatgctttgaaaggattaaagcctattatcacttgcctgctagagcatggccttttaaagcctataaactctccttacaattcccccattttacctgtcctaaaaccagacaaggcttacaggttagttcaggatctgcaccttatcaaccaaattgttttgcctatccatcccatggtgccaaacccatatactctcctatccttaatacctccctctacaaaccattattctgtactggatttcaaacatactttctttactattcctttgcacccttcatcccagcctctctttgctttcacttagactgaccctgacacccattaggctcaacaaattacctgggctgtactgctgcaaggcttcacagacagcccccattacttcagtcaagcccaaatttcatcctcatctgttacctatctcagcgtaattctcataagaacacacgtgctctccctgctgatcgtgtccgattaatctcccaaacctcaatcccttacaaaacaacaactcctttccttcctaggcatggttagtgtggtcagaattcttacacaagagccaggactgcaccctgtagcctttctgtaaacaacttgaccttactgttttagcctagccatcatgtctccgtgcagcggctgctgccaccctaatacttttagaggccctcaaaatcacaaactatgctcaactcactctctacatttctcataacttccaaaatctattttcttcctcatacctgatgcatatactttctgttccccggctccttcagctgtacccactctttgttaagtcccactattaccattttcctggcccgtacttcaatctcgcctcccacattattcctgataccacacctgacctccatgactgtatctctctgatccatctgacattcaccccatttccccatatttccttctttcctgttcctcaccctgatcacgcttgatttattgatggcacttccaccaggcctaattgccacacaccagcaaagccaggctatgctatagtacaagccactagcccgcctcttagaacctctcatttcctttccatcctggaaatctatcctcaaggaaataacttctcagttgtccatctgctattctactactcctcagggattattcaggccccctcccttctctacacatcaagctcaaggatttgcccctgcccaggactggcaaattagctttactcaacatgccccaagtcacaaaaactaaaatacctcttagtctaagtagacactttcactagacaggtagaggcctttcctacagggtctgagaaggccaccgcagtcatttcttcccttctgtcagacataattcctcagtttagccttcccacctctatacagtctgataacagaccagcctttattagtgaaatcagccaagcagtttttcaggctcttagtattcagtgaaacctttatatcccttacagtcctccatcttcaggaaaggtagaacggactaaaggtcttttaaaaacacacctcaccaagctcagccaccaacttaaaaatggactggacaatattttaccactttcccttctcagaagtcagacctgtcctcagaatgctacagggtacagcccatttgagctcctgaatagatgctcctttttattaggccccagtttcatttgacaccagaccatcttagactgtgccccaaaaaacttgtcttccctactatctctgtctagtcatactcttattcaccgttctcaactactcatacatgccgtgctcttgtttacactgccagtttacactgtttctccaagccatcacagctgatatctcctggtgctatccccagactgccactcttaactcttgaagtaaataaataatctttgctgacaggactatgctgaatttccttaggcactcttatagatgtcctaggtcctcccaattcttagacctttaatacctgtttttctccttctcttactcggtttagtttttcaattcatacaaaaccgtatccaggccatcaccaataattctaaatgacaaatgtttcttctaacagtcccataatatcaccccttaccacaaaatcttccttcagcttaatctctcccactctaggttcccatgccgcccctaatcctgctagaagcagccctgagaaacattgcccattgtctctccataccacccccaaaaatttttaccgtcccaacactttaccactattttgttttatttttcttattaatataagaagacaggaatgtcaggcctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttctcctggctcatcctggctcaaaagctcccctactgagcaccttgtgaccccccactctgcccgccagagaaaacccccctttgactgtaattttcctttacccaaatcctataaaatggccccacccctatctcccttcgctgactctcttttgggactcagcccacctgcacccaggtgaaataaacagctttattgctcacacaaagcctgtttggtggtctcttcacagggatgcgagtgaaa

SEQ ID NO: 14 - DNA, 108 bp, Homo sapiens
ggcacttgacatccaagatgtccacttggcccttttctaagtgtacttcactttgttttcattcctcctctaaagctttttaacaaactgtcactcgtgttctaaaaa

SEQ ID NO: 15 - DNA, 7833 bp, Homo sapiens
gtcaggcctctgagcccaagccaagccatcgcatcccctgtgacttgcacatatacacccagatggcctgaagtaactgaagatccacaaaagaagtaaaaatagccttaactgatgacattccaccattgtgatttgttcctgccccaccctaactgatcaatgtactttgtaatctcccccacccttaagaaggttctctgtaattctcctcacccttgagaatgtactttgtgagatccacccctgcccgcaaaacattgctcttaacttcaccgcctaacccaaaacctataagaactaatgataatccatctcccttcactgactctcttttcggactcagcccacctgcacccaggtgaaataaacagctatgttgctcacacaaagcctgtttggtggtctcttcacaaggacgcacatgaaatttggtgccgtgactcggaccaggaccgcaccctgtagcctttctgtccaaacaacttgaccttactgttttagcctaaccctcatgtctgcatgcagtggctgccactgctttaatacttttagaggccctaaaaatcacaaactatgctcaactcactctctacatttctcataacttccaaaatctattttcttcctcatacctgacgcatatactttctgctccccggctccttcagctgtactcactctttgttaagtcccacaattactattgttcctggcccggacttcaatctggcctcccacattattcctgataccacacctgacccccatgactgtatctctctgatccacctgatattcaccccatttccccatatttccttctctccgtgtctctaccccttctctgcttttctgggggaggggcaagtacccctcaatcccttctccttcacccttagtggcaagtcctgcttttctggggaaggggcaagtaccccaaccccttctctccttgtctctaccccttctctgcttttctggggaaggggcaagtaccccaaccccttctctccatgtctataccccttctctgattttctggggcaggggaaagaacccctcaaccccttctccttcacccttagtggcaagtcccgcttttctggggaagaggcaagtaccccaaccccttctctccttgtctctaccccttctctgattttctggggcaggggcaagaacccctcaactccttctccttcaccctcagcggcaagtcccacttttctgggggaggggcaagtactccaaccccttctctctgtgtctctatcccttctctgcttttctgggggagaggcaagtaccccaacctcgtatctctgcaccccgatcccttatttctgcaccctgacctcgtatctctgcaccccaaccccttctctgcttttctggagggcaagaaacccccaccccttctccgtgtctctactcttttctctgggcttgcctccttcacgatgggtaagcttccaccttccattcctctttcttctcccttagcctgtgttcttaagaacttaaaacctcttcaactttcacctgacctaaaacctaaatgccttattttcttctgcaatgccgcttgaccccaatacaaactcgacagtagtcccaaatagccagaaaactgcactttgaatttttccatcctgcaagatctaaataattcttctcgtaaaataggcaaacggtctgaggtgcctgaagtccaggcattcttttacacatcagtccctctctagtctctgttccaatgcaactcatcccaaatcttccttctttccctcctgcctgtcccctcagtcccaaccccaagcgtcgctgagtctttctaatcttccttttctacagactcttctgacctctcccctcctcgccaggccgagctaggtcccaattcttcctcagcctccgctcctccaccctataatccttttatcacctcccctcctcacacccagtctggtttacagtttcgttccgtgactagccctcccccacctgcccagcaatttactcttaaaaaggtggctggagctaaagccatagtcaaggttaatgctcctttttctttatcccaaatcagatagtgtttaggctctttttcatcaaacataaaaaacccagcccagttcatggctcattcagcagcaaccctgagacgctttacagccctagaccctaaaaggtcaaaaggccgtcttattctcaatatacattttattacccaatctgctcccgacattaaataaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaatgcctgaactgcagcagccaggcgttcctccagaacctcctcccccaggagcttgctacacatgccggaaatctggccactgggccaaggaatgcccgcagcctgggattcctcctaagccgcgtcccatctgtgcaggaccccactgaaaattggactgttcaactcacctggcagccactcccacagcccctggaactctggcccaaggctctctgactccttcccagatcttctcggcttagcggctgaagactgacgctgcccaatcacctcggaagccccctagaccatcacaggtgccgagcttccagtaactcacagtggaaggtaagtccatccccttcttaatcaatatggaagctacccactccacattaccttcttttcaagggcctgtttcccttgcttccataactgttgtgggtattgacggccaggcttctaaacctcttaaaactccccaactctggtgccagctgagacaatactcttttaagcactccttttagttatccccacctgcccagttcccttattaggccgagacactttaactaaattatctgcttccctgactattccgggattacagctacatctcattgccacctttcttcccaatccaaagccttctttgcgtcctcctcttgtattccccgaccttaacccacaactataagatacccctactccctccttggtgaccgatcatgcaccccttaccatctctttaaaacctaatcacccttaccccactcaatgccaatatcccatcccacagcacactttaaaaggattaaagcctgttatcactcgcctgctacagcataggcttctaaaacctataaactctccttacaattccccaattttacctgtccaaaaacagaacaagtcttacagattagttcaggatctgcgccttatcaaccaaattgttttgcctatccaccccgtggtgccaaacccatatactctcctatcctcaatacctccctctactacccattattctgttctagatctcaaacatgctttctttttttttgaaactttttattttttttggaaactttttactttgatatgatttatttatttatttatttttttttttttattgatcattcttgggtgtttctcgcagagggggatttggcagggccacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcgtctgtttaacaaagcacatcttgcaccgcccttaatccatttaaccctgagtggacatagcacatgtttcagagagcacagggttgggggtaaggtcaccgatcaacaggatcccaaggcagaagaatttttcttagtacagaacaaaatgaaaagtctcccatgtctacctctttctacacagacacagcaaccatccgatttctcaatcttttccccacctttcccccctttctattccacaaaaccgccattgtcatcccggcccgttctcaatgagctgttgggtacacctcccagacggggtggtggccgggcagaggggctcctcacttcccagtaggggcggccgggcagaggcacccctcacctcccggacggggcgactggccgggcggggggctgacccccccatctccctcccggacggggcggctggccaggcagaggggctcacttcccagtaggggtggccgggcagaggcgcccctcacctcccggagggggcggctggccgggcggggggctgatccccccacctccctcccggacggggcggctggccgggcggggggctgacccccccacctccctcctggacggggtggctgccgggcggagacgctcctcacttcccagacggggtggctgccgggcggaggggctcctcacttctcagacggggcggctgctgggcggaggggctcctcacttctcagacagggcggttgccaggcagagggtctcctcacttctcagacggggcggccgggcagagacgctcctcacatcccggacggggcgacagggcagaggcgctccccacatctcagatgatgggtggccgggcagagacgctcctcacttcctagatgggatggcggcctggcagagacgctcctcactttccagactgggcagccaggcagaggggctcctcacatcccagacgatgggcggccaggcagagatgctcctcacttcccagacggggtggcggccgggcagaggctgcaatctcggcactttgggaggccaaggcaggctgctgggaggtggatgttgtagcgagccgagatcatgccactgcactccagcctgggcaccattgagcactgagtgaaggagactccgtctgcaatcccggcacctcgggaggccgaggctggcggatcactcgcggtcaggagctggagaccagcccggccaacacaacgaaaccccgtctccacccaaaaaatacgaaaaccagtcaggcgtggcggcgcgcgcctgcaattgcaggcactcagcaggctgaggcaggagaatcaggcagggaggttgcagtgagccgagatggcagcagtacagtccagcttcggctctgcatcagagggagaccgtggaaagaggggagggggagggggagagggagagggagagggagagggagagggagagggagagggcatgctttctttactattcctttgcacccttcatcccagcctctctttgctttcacttggactaaccctgacacccatcagtcccagcagcttacctgggctgtactgccgcaaggtttcagggacagccctcattacttcagccaagctctgtctcatgatttagtttctttccacccctccgcttctcaccttattcagtatattgatgaccttcttctttgtagcccctcctttgaatcttctcaacaagacacacttctgctccttcagcatttattctccaaaggatagcgggtattcccctccaaagctcaaattttttccccatccattacctacctcggcataattcttcataaaaacacatgtgctctcccttctgatcatgtccgattaatctcccaaacctcaatcccttacaaaacaacaactccttttcttcctaggcatggttagtgtggtcagaattcttacacaagagccaggaccacaccctgtagcctttctgtccaaacaacttgaccttactgttttagcctagccatcatgtctccgtgcagcggctgccactgctttaatacttttagaggccctaaaaatcacgaactgtgctcaactcactctctgcatttctcataacttctgaaatctactttcttcctcatacctgatgcatatactttctgctccctggctccttcagctgtactcactctttgttaagtcccacaattaccattgttcctggcccggacttcaatctggcctcccacattattcctgataccacacctgacccccatgactgtatctctctgatccacctgatattcacccgatttccccatatttccttcttttctgttcctcaccctgatcacgcttgatttattgatggcagttccaccaggcctaatcgccacacaccagcaaaggcaggctatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagcttgaagatttgcccccacccaggactggcaaattagctttactcaacatgccctgaatcaggaaactaaaatacctcttagtctaactagacactttcactgaataagtaaagacctgtcctacagggtctgagaaggccaccgcagtcatttcttctcttctgtcagacataattcctcagtttagccttcccacctctatacagtctgataaaagaccagcctttattagtcaaatcagccaagcagtttttcaggctcttagtactcagtgaaacctttatatcccttacggtcctcagtcttcaagaaaagtagaacagactaaaggtcttttaaaaacacacctcaccaagctcagccaccaacttaaaaaggactggataatacttttaccactttcccttctcagaagtcagacctgtcctcagaatgctacaaggtgcagcccatttgagctcctgtatagacgctcctttttattaggccccagtctcattcgacaccagaccaacttagactgtgaccccaaaaaacttgtcatccctactatcttctctctagtcatactcctattcaccgttctcaactactcatacatgccctgctcttgtttacactgctggtttacactgtttctccaagccatcacagctgatatctcctggtgctatccccaaactgccactctaaactctggaagtaaataaataatctttgctggcaggactatgctgaatctccttaggcactctctaatcagatgtcctaggtcctcccaattcttagaccttttatacctgtttttctccttctcttattccatttagtttctgaattcatccaaaaccgtatccaggccatcaccaataattctatatgacaaatgtttcttctaacatccccacaatatcaccccttaccacaagatctcccttcagcttaatctctcccactctaggctcccacgccacccctaatcccgcttgaagcagccctgagaaacatcacccattctctctccataccaccccccaaaaattttcaccgccctaacacttcaacactattttgttttatttttcttattaatataagaaggcaggaatgtcaggcctctgagcccaagccaagccatcgcatcccctgtgacttgcacatatacaaccagatggcctgaagtaactgaagatccacaaaagaagtaaaaatagccttaactgatgacattccaccattgtgatttgttcctgccccaccctaactgatcaatgtactttgtaatctcccccacccttaagaaggttctctgtaattctcctcacccttgagaatgtactttgtgagatccacccctgcccgcaaaacattgctcttaacttcactgcctatcccaaaacctataagaactaatgataatccatctcccttcactgactctcttttcggactcagcccacctgcacccaggtgaaataaacagccatgttgctcacacaaagcctgtttggtggtctcttcacaaggacgtgcatgaaa

SEQ ID NO: 16 - DNA, 321 bp, Homo sapiens
taggtcaggcacgaataagcccaccccactaggaactatgttgacaaatttcaaaaaagaatctgagggagactatggagtgctatgacaccaggaaaacttaaaactttgtgtaagatagactggccagcattagaggtaggttggccattagaaggaagcctggacaggtcccttgtttcaaaggtatggcacaaggtaacctataagccaaggaacccagaccagttcccttacagagacacttgattagagctggttttagaccccccacccccaacacatagtggttgagagaacagcagcataagtggctggcag

SEQ ID NO: 17 - DNA, 636 bp, Homo sapiens
caacagcaacaagcttttcacaagttaaaagaaaacctcatgtcagccccagccctggggctaccttacctgacaaaacactttacactctatgtgtcaaaaagagaaaaaaaatggcagttagagttttaacccagactatggggccctggccaaggccagcggcctatctctcaaaacaactagacggggtttccaaaggctagcccccatgtctaagggccctggcagcaacggcctgttagcacaagaagcaaataaactaacccttaggaaaacctgaatataaaggccccccatgctgtagtaactttaatgactaccaaaggacaccattggttaacaaatgctagattaaccaactaccaaagcttgctatgtgaaaatccccgcataaccattgaagtttgcaacaccctaaacctcgccaccttgctcctggtatcagagagcccagttgaacataactgtctagaggtgttggactcagtttattctagcaggcccaacctccgacaccattcttaaacatcagtagactgtgagcagtacgtggacgggagcagctttgccaacccctgcaaagtgactctgaagaagatgacaagccctgctccagtcacacccggaagctga

SEQ ID NO: 18 - DNA, 5082 bp, Homo sapiens
aagaaactcagcctggctatcagagcttgcagtgtaaccagtgtgcttattgtaaagaaataggacattggaagaacaaatgccctcagctaaaaggaaaacaaggtgactcagagcagcaggccccagacaaggaggatggggccctgctcaacctggcagaagggttactggaatgagggggactgggctcaagggcccccaaaaagcctgtggtcaggatgaaagttgggggtaaagacattgattttcttttagataccggtgctgaacattctgtagtaaccaccccggtcgcccccttatccaaaaagactcaacataattggagccatgggggtttcagcaaagcaagctttctgcttgccccggacttgtactgcaggaggacataaagtgattcatcagtttttgtacatgcctgactgtcccttgcccttgttgggaagggacttgcttagcaagctgagagccactgtctcttttacagagcatggctctttgctgctaaagttacccagaacgggagttattatgacccttacggtcccccgagaggaggaatggagacttttcttaatgagccaggccaagtggtggccaagagtgtgggcagaagacaaccctccagggttggcagtcaaccaagcccccgtacttatagaagttaagcctggggcccagccagttaggcaaaaacagtacccggtccccagagaagctcttgaaggtatccaggtccatcaagcgcctaagaacctttggaattatggctccttgtcaatctccatggaacactcccctcctgcctgttcccaagcctgggaccaaggactaaaggccggtacaggatttgcacttggttaatcaagctacagtgactttacatctaacagtacctaacccgtacacattgttggggttgctgccagctgaggacagctggctcacctgcttggacctttctttagcatcagattagcccctgagagccagaaactgtttgcctttcagtgggaagatccagagtcaggtgttactactcagtacacttggacccagcttccccgagggttcaagaactcccccaccatcttgggggaggagacctccagaagtttcccaccagagacctaggctgcatgttgctccagtacattgatgactttctgctgggacaccccacggcagtcgggtgggccaagggaacagatgccctactctggcacctggaggactgtgggtataaagtgtccaagaaaaaagctcagatctgccgacagcaggtacgttacttgggatttactatctgacagggggagcgcagcctgggatcagaaagaaagcaggtcatttgcaatctaccagagcctaagaccagaaggcaggtgagagaattcttaggagctgtggggttttgcagactgtggatcccaaactttgcagtattagccaagcctttgtatgaggtcacaaagtggggggaacaggaactttttgaatgggaatcccgacaacaacaagcctttcataagttaaaggaaaaacttatgtcagccccagccctggggctacccgatctgacaaagccttttacattgtatgtgtcagagagagaaaagatggcagttggagttttaacccaaactgtggggccctggccgaggccggtggcctacctctctaaacaactacatggggtttctaaagaatggcccccatgtttgagggccttggcagcaactgccctgctagtacaagaagcagataagctgactcttgggcaaaacctgaacataaaggctccccatgctgtggtgacattaatgaatactaaaggacatcattggctaacgaatgttagactcaccaagtaccaaagtttgctctgtgaaaatccctgtataaccattaaagtttgtaacaccctgaaccctgctaccttgatcccagtatcagagagccctgtcaagcatgactgtgtagaagtgttggactcagtctactctagcagatctgacctctgagaccggccttgggcatcagtagactgggaactatacgtggatgggagcagcttcatcaacccacaaggagagagatgtgcagggtatgctatggtaaccctggacactgttattgaagacagatcattgccccagggcacttcagcctagagagctgaactcattgctttaatttgggccctagaactcagtgaaggtaagactgtaaacatttacactgactctcggtatgcctttttaacccttcaagtgcatggagcgttatataaagaaaagggcctattgaactctgggggaaaggacataaaatatcaacaagaaattttgcaattattagaagcagcatggaaaccccacaaggtggcagttatgcattgcagaggacaccagcgagcttccatcttggtgggtttggggaattcctgcgctgactcagaggctcgaaaagcagcatctgcccccttccaggcatcagtcacagaccccctgctccctcaagcacttgatcttgtagctacttattcgggagaatagctctgccacagctgctaggagccgcaattgtactggttttgcatgaaaccacccatctaggtcaggagtcacttgaaaagttgttaggccggtatttctacatctcatatttgtcaacccttgccaaaacagtgacgcagcagtgtgttacctgccgacagcataatgtgaggcaaggtctagctgttcccccccggcatacaagcttatagagcagcctcctttgaagatctccaggtggacttcacagagatgccaaagtgtggaggtaacaagtatttactagttcttttgtgtacctactgtgggtgggtggaggcttatccaacactaactgagaaagctcgtgaagtaacctgtgtgcttcttcgagatcttattcctagatttggactgcccttacggatcagctcagataatgggctaacgtttgtggctgacttggtacagaagatagcaaaggtattggggatcatttggaaactgcatgccgcctaccggcctcagagttccagaaaggcagagcagatgaatcagactatcaaaaatagtttagggaaagtatgtcaggaaacaggattaaaatggatacatgctctctatagtattatttaaaattagatgtaccccttctaaaagaacaggatattccccttaggaaatattatatcatgggacccttcccatattgcagggacttccaggcacttcctgagagttaggtgaaattgagttacagcgacagctacaggctttaggaaaaattacacaaacaatctcagcctgggtaaatgagagaccctgttagcttattctccccagttcaccttttctccccaggtgttcgagtgtggatcaaggactggaacgtagcctctttgtgcccatggtggaaaggaccccagactgtcgtcctgatcactcccactgctgtgaacgtagagagaatcctagcctggatccatcacaaccgtgtaaaacctgcagcgcctgaatcctgggaggcaagaccaagtctggacaacccctgcagagtgaccctgaagaagatgacaagccctgctccagtcacacccagaagctgactggtccacgcacagccgaagcatgaggaagctcattgtgggcttcatttttcttaaattttggacttacagtaagggcttcaactgttcttactcaaactggggactattcccagtgtattcatcaggtcagtgaggtaggacagcaaatgaaaacaatctttctgttctatagttattatcaatgtatgggaacgttaaaagagacttgtttgtataatgccactcagtacaaggtatgtagcccaggaaatgactgacctgatgtgtgttataacccatctgagccccctacaaccaccagttttgaaataagattaagaactggccttttcctaggtgatacaagtgaaataataactagaacagaagaaaaaggaatccccaaacaagtaactttaagatttgacgcttgtgcagccattaatagtaacaagctaggaacaggatgtggttctcttaactgggaaaggagctacagagtagaaaataaatatgtttgtcatgagtcaggggtttgtgaaaattgtgccttttggccatgtgttatttaggctacttggaaaaagaacaaaaaggacttggttcatcttcagaaaggggaagccaacccctcctgtgctgccagtcactgtaacccactagaactaataattaccaatcccctagatccccattggaaaaagggagaatgtgtaaccctggggatcaaagggacagggttaaacccccaagttgccattttagttcaaggggaggtccacaagcactctcccaaaccagtgtttcaaaccttttatgaggagttaaatctgccagcaccagaacttctgaaaaagataaaaaatttgtttctccaattagcagaaaatgtagctcattcccttaatgttacttcttgttatatatgcgggggaaccactatcagagaccgatggccttgggaagcctgagagttggtgcccactgatccagctcctgatataatgggggcttgtccaggatctcatcaggactggatggctctcgctggactatactggatatgtgggcagagagcctacattcagttacctaatgaatgggcagacagttgtgttattggcactattaagccatcctttttcttattaccgataaaaactactggtactatctgtaaattccagacattgtatgagaaagcactgtaaaactttttgttctgttagctgatatatgtagcctccagtcacattcctcatgcttacttgatctatcatgaccctttcacgtggaccccttagagttgtaagcccttaaaagggctaggaatttctttttgggggagcttggctcttaagacatgagtctgccaatgctaccggccaaataaaaacctcttccttctttaatccagtgtctcaagagttttgtctgcagctcatcctgctaca

SEQ ID NO: 19 - DNA, 6026 bp, Homo sapiens
gtcaggcctctgagcccaagccaagccatcgcatcccctgtgacttgcacgtatacgcccagatggcctgaagtaactgaagaatcacaaaagaactgaaaaggccctgccccgccttaactgatgacattccaccatggtgatttgttcttgccccaccttaactgagtgattaaccctgtgaatttccttctcctggctcagcagctcccccactgagcaccttgtgacccccgcccctgcccaccagagaacaaccccctttgactgtaattttccattaccttcccaaatcctataaaacggccccaccccatctcccttcgctgactctcttttcggactcagcccgcctgcccccaggtgaaataaacagccatgttgctcacacaaagcctgtttggtgtctcttcacatggactcgagtgaactttgatgccgtggctcggatcgggggacctcccttaggagatcaatcccccgtcctcctgctctttgctccatgagaaagatccacctacgaccttaggtcctcagaccaaccagcccaagaaacatctcaccaattttaaatccagtaagccgcctctttttactctcttctccaacctccctcactatccctcaacctctttctcctttcaatcttggcgccacacttcaatctctcccttctcttagtttcaattcctttcattttctggtagagacaaaggagacacgttttatctgtggacccaaaactccagcgctggtcacggactgggaaggcagccttcccttgctgtttaatcattgcagggacacctctctgattattcacccacgtttcaagggtgtcagaccatgcagggatgcctgccttggtccttcacccttagcggcaagtcccgcttttctggggaaggggaaagtaccccaaccccttctctctgtgtctctacccgttctctgcttttctggggaaggggcaagtaccccaaccccttctctctgtgtctctaccccttccctgcttttctggggaaggggcaagtaccccaaccccttctcttcttgtctctaccccttctctgattttctggggcaggggcaagaacccctcaaccccttctccttcacccttagtggcaagtcccacttttctgggggaggggaaagtacccctcaaccccttctccttcacccttagtggcaagtcccgcttttctagggggcaagaacccccaatcccttatttccacaccccgacctcttatttctgtgacccaatcccttatttccacaccccaacctcttatctctgtgccccaatcccttatttccatgccccaaccccccttcccacttttctagggggcaagaacccccaatcccttatttccacaccctgacctcttatctctgtgccccaatcccttatttctgtgccccaaccctttctctgcttttctggagggcaagaaacccccaccccttctccgtgtctctactcttttctctgggcttgcctccttcactatgggcaagcttccaccttccattcctccttcttctcccttagcctgtattcttaagaacttaaaacctcttcaactctcacctgacctaaaatctaagtgtctcattttcttctgcaatgcctcttgaccccaatacaaactctacagtagttccaaatagccggaaaacggcactttcaatttttccatcctacaagatctaaataattcttgtcataaaatgggcaaatggtctgaggtgcctgacatccaggcattcttttacacatcagtcccttcctagtctctgtgcccagtgcaactcattctgaatcttccttctttccctcccgcctgtcccctcagtcccaaccccaagcgtcactgagtctttctaatcttccttttctacagacccatctgacctctcccctccttgccaggccaagctaggtcccaattcttcctcagcctccgctcctccaccctgtaatctttttatcgcctcccctcctcacacctggtctggcttacagtttcgttctgtgactagccctcccccacctgcccagcaatttactcttaaaaaggtggctggagccaaaggcatagtcaaggttaatgctcctttttctttatcccaaatcagaagcgtttaggctctttttcatcaaatataaaaacccagcccagttcatgtctcgttcggcagcaaccctgagatgctttacagccctagaccctaaaaggtcaaaaggccatcttattctcaatacacattttattacccaatctgctcccgacattaaataaaactccaaaaattagaatctggccctcaaaccccacaacaggacttaattaacctcaccttcaaggtgtacaataataaaaaaaaggaagttgcaattccttgcctccactgtgagacaaaccccagccacatctccagcacacaacaacttccaaatgcctgaaccgcagtggccagacattcctccagaacctcctcccccaggagcttgctgcaagtgccagaaatctgaccaccagggcaaggaatgcctgcagcccagggattcctcctaagccatgtcccatctgtgcgggaccccactggaaatcggactgttcaactcacctggcagccactcccagcgcccctggaactctggcccaaggctctctgactgactccttcttggcttagtggctgaagactgacgctgcctgatcgcctcagaagccctgtagaccaccatggacaccgagctttaggtaactctcacagtggagggtaagtctgtccccttcttaatcaatatggaggctacccactccacattaccttcttttcaagggcctgtttcccttgcctccataactgttgtgggtattgacagccaggcttctaaacctcttaaaactccccaactctggtgccaacttgaacaacactcttttatgcactcttttttagttatctccacctgcccagttcccttatcaggccgagatattttaaccaaattatctgcttccctgactattcctggactacagctgcatctcattgctgcccttcttcccaatccaaagcctcctttgcgtcctcctcttgtattcccccaccttaacccacaagtataagatacctctactccctccttggcgaccgatcatgcaccccttaccatctcattaaaacctaatcacgcttacccgactcaatgccaatatcccatcccacagcatgctttgaaaggattaaagcctgttatcactcacctgctacagcatggccttttaaagcctataaactctccttacaattcccccgttttacctgtcctaaaaccagacaaggcttacaacttagttcagaatctgtgccttatcaaccaaattgttttgcctatccaccccgtggtgccaaacccatatactctcctatcctcaatacctccctctactacccattattctgttctggatctcaaacatgctttctttactattcctttgcactcttcatctcagcctctctttgccttcacttagactgaccctgacacccattaggctcagcagcttacctgggctgtgctgccgcaaggttccagggacagccctcattacttcagccaagctctttctcatgatctactttctttccacccctccacttctcaccttattcaatatattgatgaccttcttctttgtagcccctcctttgaatcttctcaacaagacatacttctgctccttcagcatttattctccaaaggatatcgggtatccccctccaaagctcaaatttcttctccatccgttacctacctcggcataattcttcacaaaaacacaggtgctctccctgctgatggtgtctgattaatctcccaaacctcaatcccttacaaaacaacaactcctttccttcctaggcatggttagtgcggtcagaattcttacacaagagccaggaccccaccctgtagcctttctgtccaaacaacttgaccttactgttttagcctagccctcatgtctgcatgcagcagctgccgctgctttaataattttagaggccctaaaaatcacaaactatgttcaactcactctctacatttctcataacttccaaaatctattttcttcctcatacctgacgcatatactttctgctccccggctccttcagctgtactcattctttgttaagtcccacaattaccattgttcctggcccagacttcaatctggcctcccacattattcctgataccacacctgatccccatgactgcatctctctgatccacctgacattcaccccatttccccatattacaagccactagcccatctcttagaacctctcatttcctttccattgtagaaatctatcctcaaggaaataacttctcagtgttccatctgctattctatctgctattctgctactcctcaaggatcattcaggcccctcccttccctacacatcaagctcgaggatttgcccccgcccaggactggcaaattagctttactccacatgccccgagtcacaaaaactaaaatacctcttagtctaagtagacattttcactagataggtagaggcctttcctacagggtctgagaaggccaccgcagtcatttcttcccttctgtcagacataattcctcagtttagccttcccacctctatacagtctgataacagaccaggctttattagtcaaattagccaagcagtttttcagtttatatcccttatagtcctctgtcttcaagaaaagtagaacggactaaaggtcttttaaaaacacacctcaccaagctcagccaccaacttaaaaagaactggacaatacttttaccactttcccttctcagaagtcagacctgtcctcagaatgctacaaggtacagtccatttaagctcctttttattaggccccagtctcatcccagacaccagaccaacttagactgtgcccccaaaaaaacttgtcatccctactattttccgtctagtcatactcctattctccgttctcaactactcatacatgccctgctcttgtttacactgccagtttacactgtttctccaagccatcatggctgatatctcctcatgctatccccaaactgccactcttaactcttgaagtaaataaataatcttcgctggaaggactatgctgaacctccttaggcattctctaattagatgtcctagatcctcccaattcttagtccttttatacctgtttttctccttctcttattccatttagtttttcagttcatacaaaaccgtatccaggccatcaccaatctttctgtatgacaaatgtttcttctaacaaccccctcaatgtcaccccttaccacaagacctcccttcagcttaatctctcccactctaggttcccacgccgcccctaatcccgcttgaagcagccctgagaaacatcgcccattctctctccataccaccccccaaaaattttcaccgccccaacacttcaacacaattttgttttatttttcttattaatataagaaggcaggaatgtcaggcctctgagcccaagccaagccatcgcatcccctgtgacttgcacgtatacgcccagatggcctgaagtaactgaagaatcacaaaagaactgaaaaggccctgccccgccttaactgatgacattccaccatggtgatttgttcttgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaacggccccacccctatctcccttcgctgactctcttttcggactcagcccgcctgcccccaggtgaaataaacagccatgttgctcacacaaagcctgtttggtgtctcttcacacggacgcgcatgaaa

SEQ ID NO: 20 - DNA, 6698 bp, Homo sapiens
gtcaggcctctgagcccaagctaagccatcgtatcccctgtgacctgcacatatacatccagatgacctgaagcaagtgaagaatcacaaaagaagtgaaaatggccggttcctgccttaactcatgacattccaccattgtgatttgttcctgccacaccgtaactgagccattaaccttgggaaattccttctcccggctcagaagctcccccactgagcaccttgtcacccccacccctgcccaccagagaacaaccccctttgactgtgattttccaccacctacccaaatcctataaaacagccccacccctatctccgtttgctgactctcttttcagactcagcctgcctgcacccaggtgaaataaacagccttgttgctcacacaaagtctgtttggtggtctcttcacatggacgcacgtgacatttgggcaggggacctcccttgagagatcgatcccctgtcctcccactctttgctccatgagaaagatccacctacaaccttgggtcctcagaccaaccagcccaagaaacatctcaccaatgttaaatcgggtaagcggcctctttttactctcttctccagcctctctcactatccctcaaacctctttctactttcaatcttggcaccatccttcaatctctctcttctcttaatttcaattcctttccttttctggtagagacagaggagacacgttttatccgtgaacccaaaactctggcgccagtcacggactcaggaaaacagtcttcccttggagtttaatcactgcgggaacacctgcttgattactcacccatgtttcagaggtgtctgatcaccatggggaagcctgccttgatccttcacctttagtggcaagcaccactttcctgggggtcaatcaccccctaccccttctctccgtgtctctatcctctcttttctctgggcttgcctccttccctataggaaaacttccaccctccattcctcctccttctcccttagcctgtgttctcgagaacttaaaacctcttcaactcacatctgacctaaaacctaaaccccttattttcttctgcaataccacttaaccccaatacaaactccacaatggttccaaatagccagaaaatggcactttcgatttttccatcctacaagatctatataattctttttgtaaaatgggcaaatgcctgacgtccaggcattcttttacacgtgggtccctccctagtctctatttccaatgtgacttgtctcaaatcctccttctttccctcctgcctgtcccctcagtcccaaccccaagcgtcactgagtcttttcaatcttccttttctactgacccatctgacctctcccctcctccccagactgttcctcctcaggtcactccctgccaggccgaatcaggctccaattcctcctcagcctctgctccccaaccctataatccttctatcacctcccctcctcacacccagtccagcttacgtcttatagtttcattccgcgactagctttccccaacctgcccaacaatttcctcttaaaaaggtggctggagctaaaggcatagtcaaggttaatgcccctttttatttatccaacctctcccaaatcagttagcatttaggctctttttcatcaaatataaaaacccagcccagttcatggcttgtttggcagcaaccccgagacgctttacagccctagatcctgaagggtcagaaagctgtcttattctcaatatgcattttattacctaatcttctcctgacattaaataaagctccaaaaattagattttggccctcaaaccccacaacaggacttaattaacctcgccttcaaggtgtacaataatagagtagagacagccaagtagcaacatatttctgagactgcaattccttgcctccactgtgagagaaaccccagccacatctccagcacacaagaattttaaaatgcctaagccacacatgcctaagccacaatggtcaagcattcctacaggacctcctccattaggaccttgcttcaagtgccagaaatctggccactgggccaaggaatgtctgcagcccgggattcctcctgtgccatgtcccacccatgcagagacccactggaaatcagactgtccagcttgcctagcagccactcctagagcccctaaagctccagcccaaggttctctaactgactccttcccacatcttctcagcttagcggctgatgactgaccctgcctgatctccttggaagcctcctggaccataacagatgctttgggtaaatcttaacagtggagggtaagtccacccccttcttgatcagtatggaggctacccactctacattgcattcttttcaagggcctatttcccttgcctccataactgttgtgggtattgatggccaggcttcaaaaccccttaaaactcccccactctggtgccaacttggacaacattcttttatgcactcctttttagttatccccaccttcccagctcccttattaggtcaagacattttaactaaattatctacttccctgactatgcctaggctacagcctcatctcattgctgcccttttccccagttcaaagcctcctttgcatcctccccttgtatctccccaccttaatccacaagtataagacactctactccctccttggtgaccaatcatgcaccccttagtatcccattaaaaccaaatcacccttaccccactcaatgccaacatcccatcccacagcacgctttaaaaggattaaagcccattaccacttgcctgttacaacatggctttttaaagcctataaactctccttacaatacccaattttacctgtccaaaaaccggacaagccttacaagttagttcgggatctgcaccttatcaaccaaattgtcttgcctatccaccctgtggtgccaaacccatatactctcctatcctcaatacctccctctacaacccctctataacccattattctgttctggatctcaaacatgctttctttactattcctttgcacccttcatcccagcctctctctgctttcacttggactgaccctgacacccatcaggctcagcaaattacctgggctgtactgccgcaaggcttcacagacagcccccattatttcagtcaaacccaaatttcttcctcatctgttacctatcttggcataattcttcatgaaaacacacgttctctccctgctgattgtgtccggctaatctcccaaaccccaaccctttctacagaacaacaactcctttccttcctaggcatggttaggtacttctgcctttagatacctagttttaccatcctgactaaaccattatataaactcacaaaaaaaaaaaaaaaaaaaaaaaaaaaaaaaaactagctaaccccatagatcctaaatcctttccccactcccctttccattccttaaaaacagccctagaagctgctcccatgctagttctcactaactcatcccaaccctttttattacacatagccagcgtacagggctgtgtggtcaaaattcttacacaagagcccgggactgcgccctgtagcctttctgtccaaacaacttgaccttactgttttaggctggccatcgtgtctctgtgtggcggctgccactgccctaatacttttagaggccctcaaaatcacaaactatgctcaactcactctctacagttctcataacttccaaaatctattttcttcctcacacctgatgcatatattttctgctccctggctccttcagctatactcactctttgttgagtctcccacaattaccattgttcctggcctggacttcaatctggcctcccacattattcctgataccacacctgacccccatgaatgtatctctctgatccacctgacattcactccatttccccatatttccttctttcctgttcctcaccctgatcacatttggtttattgacggcagttccaccaggcctaatcaccactcaccagcaaaggcaggctatgctatagtatcttccacatctatcattgacgctaccactctgtccccctccactacctctcagcaagccaaactcattgccttaactcaagccctcactcttgcaaaaggactacacatcaatacttatactgactctaaatgtgccttccatatcctgcaccaccatgctgctatataggctgatggggtttcctcactaagcaagggtccttcatcattaacatctctttgataaaaactcttctcaaggtcgctttacttccaaaggaggctggagtcattcactgcaagggccatcaaaaggcatcagatcccatcactcggggcaaagcttatgcagataaggtagctaaaaaagcagctagtgttccaacttctgtccacggccagttttcctccttctcgtgggtcactcccacctactcccccagtgaagcttccacttgtcaatctcctcccacacaaggcaaatagttcttggaccaaggaaaatatctctttccatcctcacaggcccattctattctgtcgtcatttcataacctcttccatgtaagttacaagccactagcccacctcttaaaacctctcttttcctttccatcgtaaacatctatcctcaaggaaatcacttctcagtgttccatctgctattctactactcctcaggaatttctcagggcccctcccttccctacacatcaagctcagggttttgcccctgcccaggactgacaaattgactttactcacatgccccgagtcaggaaactaaaatacctcttggtctgggtagacactttcactggatgggtagaggcctttcccacagggtctgagaagtccactgcaatcatttcttcccttctgtcagacataattccttggtttggccttcccacgtctatacagtccaataacagaccagcttttattagtcaaatcacccaagcagtttctcaggctcttggtattcagtggaaccgtcataacccttaccgttctcaatcttcaggaaaggtaaaatggactattggtcttttaaaaacacacctcaccaagctcagcctccaacttaaaaaggactggacaatacttttaccacttgcccttctcagaattcaggcctgtcctcaggatgctacagggtacagcccatttgagctcctgtatggacgttccattttattaggccccagtatcattccagacaccagcccaacttgaactgcaccccaaaaacttgtcatccctactatcttctctctagtcatactcctattcaccattctcgactactcgtaaataccctgcccttgtttacactgccggtttacacttttcctccaaaccatcataactgatatctcctagttttacctcaaaccactacccttaagtctgtcttaaagtggataatctttgttgacagggtacactccaatactttcaccctgatgaagtcctattctttacttgtatactcactcttattcctgttcccattcttatgccatcctctgcctctccccagctatctccaccacactatcaatcacactcactctctcctagccatttctaatccttctttaacaattgctggctttgcagttgctggctttgcatttccctttcctccaaaatcgcggaggccttgacttactgccaaataaaaataaaaaataaaaaaataaaaaactccatgtatttttaaataaagagtgttgcttttacctaaatcaatctggccttgtatatgacaagataaaaaaactcaaggatagagccccaaaacttgccaaccaagcaagtaattatgctgaacccccatggacactctctaattggatgtcttgggtcctcccaattcttagtcctttaatacctgttttcctccttctcttattcggaccttgtgtcttccgtttagtttctcaattcatacaaaaccgcatccaggccatcaccaatcattccatatgacaaatgttccttccaacaaccccacaatatcacaccttaccacaaaatcttccttcagcttaatctcccccagtgtaggttcccacaccgcccctaatctggcttaaagcagccctgagaaacactgtccattatctctccataccacccccctaaaatttttgctgccccaacacttcaatactatttcatgttacttttcttattaacataagaagacaggaatgtcaggcctctgagcccaagctaagccatcgtatcccttgtgacctgcacatatacatccagatggcctgaagcaagtgaagaatcaggaaagaagagaaaatggccagttcctgccttaactgatgacattccaccattgtgatttgttcctgccacaacttaactgagccattaaccttgggaaattccttcttctggctcagaagctcccacactgagcaccttgtgacccccgcccctgcccgccagagaacaacccgctttgtaattttccaccacctacccaaatcctataaaatggccccacccctatctccctttgctgactttctttttggactcagcccacctgcacccaggtgaaataaacagctttgttgctcacacaaagcctgtttggtggtctcttcacacagagggcatga

SEQ ID NO: 21 - DNA, 2376 bp, Homo sapiens
acaacttgaccttactgttttaggctggccatcatgtccccgtgcagcagctgccgctgccctaacacttttagaggccctcaaaatcacaaactatgctcaactcactctctatagttctcataacttccaaaatctattttcttcctcacacctgatgcatatactttctgctccccggctccttcagctgtactcactctttgttgagtctcccacagttaccattgttcctggcccggacttcaatccagcctcccacactattccggatacatctgactcccatgactgtatctctctgatccacatgacattcactccctttctccatgtttccttctttcctgttcctcaccctgatcacacttggtttattgatggcagttccaccaggcctaatcgccactcaccagcaaaggcaggctatgctatagtatcttccacatctatcactgaggctaccgctctgcccccctccattacctctcagcaagctgaactcactgccttaacttgagccctcactcttgcaaagggactacccatcaatatttatactgactctaaatatgccttccatatcctgcaccaccatgctgttatataggcagaaagaagtttcctcactatgcaagagtcctccatcaataatgcctctttaataagaactcttctcaaggctgctttacttccaaagaaagccggagtcattcactgcaaaggccatcaaaaggcttcagatcccattgctctggacaacgcctatgctgataagatagctaaaaaagcagctagcgttccaacttctatccctcagggcagttttcctccttctcatctggccactcccacctactccctcgctgaaacttccacccatctcttcccacacaaagcaaatggttcttggaccaaagaaaaatctccttccagtctcacaggcccattctattcgtcatttcataacctcttccatgtaggttgcaagccgctagcccgcctcttagaacccgctagcccacctcttagaacctctcatttcctttccatcgcaaaaatctatcctcaaggaaatcacttttcagtgttccatctgctattctactactcctcaagaatttctcaggccccctcccttccccacacatcaagctcggggatttgccccgcccaggactggcaaattgactttactcacatgcctcgagtcaggaaactaaaatacctcttggtctgggtagacactttcactggatgggtagaggcctttcccacagggtctaagaaggccaccgtggtcatttattcccttctgtcagacatagttcctcggtttggccttctcacctctatacagtccgataacggaccggcctttactagtcaaatcacccaagcagtttctcaggctgttggtattcagtggcacctggtttttcctcaaactgccacccttaagtctctctttaagtggatagaagatcttcagtggcaaggtaccctccaatactttcaccctgatgaagtcctattctttacttttatacttactcttattctcattcccgttcttatgccaccctctacctctccccagctatctctatcacactatcaatctcagttactctctcctagccgtttctaatccttctttaacaaacaattgctggctttgcatttctctttcttccaaaatcacaaaggtctcgacttactgctaaaaaaaaaaaaaaggggactctatatttttaaatgaagagtgctatttttacctaaatcaatctggcctggtatatgacaacattaaaaaaaactcaaagatagagcctaaaagcttgccaaccaagcaagtaattacactaaccccccttggacactctaattagatgtcctgggtcctcccaattcttagtccttttatacctgtttttctccttctcttattcagaccttgtgtcttccatttagtttctcaattcatccaaaaccatatccaggccatcaccaatcattctatacgacaaatgtttcttctaacaacccgacaattatcaccccttaccacaaaatcttccttcagcttcatctctcccacactaggtttccatgttgccccagtcctgctcaaagcagccctgagaaacattgcccattatctctccataccaccccccaaaattttccccaccccaacactttaccactattttatttttcttattaatataagaagacaggaatgtcaggcctctgagcccaagctaagccatcatatccccagtgacctgcacgtatacatccagatggcctgaagcaactgaagatacacaaaagaagtgaaaatagccttaactgataacattccaccat

SEQ ID NO: 22 - DNA, 470 bp, Homo sapiens
gtcaggcctctgagcccaggccaggccattgcatcccctgtgacttgcacgtatacatccagatggcctaaagtaactgaagatccacaaaagaagtaaaaacagccttaactgatgacattccaccactgtgatttgttcctgcgccaacctaactgataaatgtactttgtaatctcccccacccttaagaaggtactttgtagtctcccccacccttaagaaggttctttgtaattctccccacccttgagaatgtactttgtgagatccacccctgcccaccagagaacaacccctttgactgtaattttccattaccttcccaaatcctataaaatggccccacccctatctcccgttgctgactcgcttttcggactcagcccacctgcacccaggtgaaataaacaaccatgttgctcacactaagcctgtttggtggtctctttgcacagatgcacatgaaa

SEQ ID NO: 23 - DNA, 5517 bp, Homo sapiens
gtcaggcctctgagcccaggctaagccatcatgtcccctgtgacctgcatgtacacatccagacggctggttcctgccttaactgctgacattccaccacaaaagaagtgaaaatgtcctgttcctgcctcaactgatgacattgtcttgtgaaattccttctcctggctcatcctggctcaaaagctcccccactgagtaacttgtaacccccactctgcccgccagagaacaaccccccctttgactggattgggtaggatttacctacccaaatcctataaaacggccccacccctatctcccttccctgactctctttttggacccagcacacctgcacccaggggaaataaacagctttattgctcacagaaagcctgtttggtggtctcttcacacagacacgagtgaaatttggtgctgtgacttggatcgggggacctcccttgggacatcaatcccctgtcctcctgttctttgctccgtgagaaagatccacctacaacctcaggtcctcagactgaccagcccaagaaacgtctcaccaatttcaagtatggtaagtggcctctttttactctctcctccaacctcacttactatccctcaacctctttctcctttcaatcttggcaccacacttcaatctctcccttcttttaatttcaattcctttcattttctggtagagacaaaggagacgcgttttatccgtggacccaaaactccagtgctggtcacggactgggaaggcagccttcccttggtgtttaatcatttcagggacgcctctctgattattcacccatgtttcagaggtgtcagaccacgcagggacgcctgtcttggtccttcacccttagaggcaagtcccgcttttctaggggaggggaaagtaccccaacctcatatctctgtgccctgatcccttatttccacaccccaacctcttatatctctgtgccccgatcccttatttccgtgcccctacctctcccgcttttctggagggtaagaacccccaaaccccttccctccgtttctctactctctcttttctctgggcttgcctccttcactgtgggcaaccttccaccctccattgctccttctcccttagcctgtgttcttaagaacttaaaacctcttcagctctcacctgacctaaactctcagcatcttattttcttccgcaatgccacctgaccgcaatacaaactcgacagtagttccaaatagccagaaaacggcactttcaatttttccatcctgcaagatctaaataattcttgttgtaagatgggtaaatggtctgaggtgcctgacgtccaggcattcttttacacgtcggtccctctctagtctctgttcccaatgcaactcatcccaaatcttccttctttccctcccacccgtcccctcagtcccaaccccaagggtcgctgagtctttctaatcttccatttctacagacccatctgacctctcccctcctccccaggctgctcctcgccaggccgagctacgtcccaattcttcctcagcctctgctcctccaccctataatccttttatcacctcccctcctcacacctggtccggcttacagtttcgttccgtgaccagccctcccccacctgcccagcaatttactcttaaaaaggtggctggagctaaaggcatagtcaaggttaatgctcctttttctttatcccaaatcagatagcgtttaggctctttttcatcaaatataaaaatccagcccagttcatgacttgtttggcagcaaccctgagacactttacagccctagaccctaaaaggtcaaaaggccgtcttattctcaaaatacattttattacccaatctgctcccgacattaaataaaactccaaaaattaaattccggcccttaaacccctcaacaggatttaattaacctcaccttcaaggtgtacaataatagaaaaaagttgcaattccttgcctccactgtgagacaaaccccagccacatctccagcacacaagaacttccaaacgcctgaaccacagcggccaggccttcctccagaacatcctcccccaggagcttgctacaagtgccagaaatctggccaccaggccaaggaatgcctgcagcccgggattcctcctaagccacgtcccatctgtgcgggaccccactggaaatcggactgtccaactcacctggcagccactcccagagcccctggaactctggcccaaggctctctgacggcttcccagatcttcttggcttagcggctgaagactgactctgcccgatcacctcggaagccccctaggccatcacggacgccgagcttcgggtaactctcacggtggaagctaagcccgtccccttcttaatcaatacggagcctacccactccacattaccttcttttcaagggcctgtttcccttgcctccataactgttgtgggtattgacggccaggcttctaaacctcttaaaactccccaactctggttccaacttagacaatactcttctaagcactccttttagttatccccacctgcccagttcccttattaggccgagacactttaactaaattatctgcttccctgactattcctgtattacagctacatctcattgctgcccttcttcccaatccaaagcctcctttgcgtcctcctcttgtattctcccaccttaacccacaagaataagatacctctactccctccttggcgaccgatcatgcaccccttactatctcattaaaacctaatcacccttaccccgctcaatgccaatatcccatcccacaccatgctttgaaaggattaaagcctgttatcactcacctgctacagcatggccttttaaagcctataaactctccttacaattcccccattatacctgtcctaaaaccagacaagccttccaagttagttcaggatctatgccttatcaaccaaattgttttgcctatccaccccatggtgccaaacccatatactctcctatcctcaatacctccctccacaatccattattctgtgctggatctcaaacctgctttctttactattcctttgcacccatcatcccagcctctcttcgctttcacctggactgaccctgacacccatcaggctcaggaaattacctgggctgtactgccgcaaagtttcacagacagcccccattacttcagtcaagcccaaatttattccttatctgttacctatctcagcataattctcataaaaacacacgtgctctccctgctgatgtccaattaatctcccaaacctcaatcccttacaaaacaacaactcctttccttcctaggcatggtttgtgcggtcagaattcttacacaagagccaggaccgcaccctgtagcctttctgtccaaacaacttgaccttactgttttagcctagccctcatgtctgcgtgcgtggctgctgccaccctaatacttttagaggccctaaaaatcacaaactatgctcaacttactctctacatttctcataacttccaaaatctattttcttcctcatacctgacgcatatactttcggcttcctggctccttcagctatactcactctttgttaactcccacaattaccattgttcctggcccggacttcaatctggcctcccacattattcctgataccacacctgacctccatgactgtatctctctgatccacctgacattcaccacatttccccatatttccttctttcctgttcctcaccctgatcacgcttgatttattgatggcagttccaccaggcctaatcgccacacaccagcaaaggcaggctatgctatagtacaagccactagcccccctcttagaacctctcattttctttccatcgtggaaatctgtcctcaaggaaataacttctcagtgttccatctgctattctactactcctcagggattattcaggccccctcccttccttacacatcaagctcgaggatttgcccctacccaggactggcaaattagctttactcaacatgccccgagtcagataactaaaatacctcttagtctaggtagacactttcactggataggtacaggcctttcctacagggtctgagaaggccaccgcagtcatttcttcccttctgtcagacacaattcctcagtttagccttcccacctcaatacagtctgataacagacgagcctttattagtcaaatcagccaagcagtttttcaggctcttagtattcagtgaaacctttatatcccttatggtcctccgtcttcaggaaaagtagaatggactaaaggtcttttaaaaacacacctcaccaagctcagtcaccaacttaaaaaggactggacaatacttttaccactttcacttctcagaactcaggcctgtcctcggaatgctacagggtacagcccatttgagctcctttttttattaggccccagtctcattccagacaccagaccaacttggactgtgccccaaaaaacttgtcatccctactatcttctgtctagtcatactcctattcaccgttctcaactactcatacatgccctgctcttgtttacactgccagtttacactgtttctccaagccagcacagctgatatctcctggtgctatccccaaaccgccactcttaactcttaaagtaaataaataatctttactggcaaggctatgctgaaccaccttaggcactctctaattagatgtcgtaggtcctcccaattctgagtcctttaatacctgtttttctccttctcttattctgtttagtttttcaattcatacaaaactgtatccaggccaacaccaataattctaaataacaaatgtttcttctaacagccccacaatatcaccccttgccacaaaattttccttcagcttaatctctcccactctaggttcccacgccgcccctaatcccgctcgaagcagccctgagaaacatcacccattatctctccataccaccaaaaaattttcactgtcccaacactttaccactatttcattttattgttcttattaatataagaagacaggaatgtcaggcctctgagcccaagctaagccatcacataccctgtgacctgcaggtacacatccagatggctggttcctgccttaactgctgacattccaccacaaaagaagtgaaaatgtcctgttcctgccttaactgatgacattgtcttgtgaaattccttctcctggctcatcccggctcaaaagctcccccactgagtaccttgtgacccccactctgccggccagagaacacccccctttgactgtaattttcctttatctacccaaatcctataaaacggccccacccctatttcccttcgctgactctctttttggactcagcccacctgcacccaggtgaaataaacagctttattgctcacacaaagcctgtttgatggtctcttcacatggatgagagtgaaa

SEQ ID NO: 24 - DNA, 2715 bp, Homo sapiens
agtaagcccaccctactaggaactatgttaaaaaatttcaagaaagaatttaaaggagattacggtgttactgtgacaccaggaaaacttagaactttgtgtgaaatagactggccagcattagaggtaggttggccatcagaaggaagcctggacaggtcccttgtttcaaaagtatggcacaaggtaacctgtaagccaaggcacccaggccagtttccgtacatagacagttacagctagttttagacccccttccccccaacagcagttaagagaacagcagcataagtggctggcagaggcaaggaaagaccagcagagagaaaaagaggccatctataccaattctaagttaattcagactaaacaagatcttattaatagcaaaggataattgaaatcccaaacttacaaggttttcaacaaaagtgaagtttgctaaaagttaacagtgtaacatgtattatagtaacttctaatcttgtggccttagacagtctagtccaaagacataaagaaagttcgctttaaaaaagagaagggcgggggggggaggcaaaatttatgtaaaaagagtgttatatagtaaattcttgtcctgaaataaattaactagttgtttaaagaaaaaaatgtaataagtcaaaaagttaagacatgttgaaaaattgtctgcaaaagtcgtgaaagaaaaaatgttataaaaaaatttatgcaaaaaatgttgtataatttaaaagtaataaggcctcctgagtaccattaaagaaacagtttatgtgcaaggtgtataagaaaagtaaaatatacctttagtaaaaaaattataaagggacataaaaatgtggatttttacctacattaaaagttaaaaaaattattgttttaaaaatttaagcaagttttaaaacgttaattgtaaagaaaattctgtgtgtaaacatattagctaaagttaaaaagatatcacccagtttttctgtgaactggacattaaagtaaaaatgcaacaggtttttcttaaagcatcaacctgctctttaacaaaaattataaaaagttaaaaaaagtctataaaatcttaccttatggtcaaacataaaaaattagataaatatgtctacaaggttttattaaaattaagtttaacattaataacacactaatataaaagtaaaatttaacttatctactataaaaatcatacaagaaacattattaaatataaaatagtatttagctttctttagtctaaaaactaataaaaataggtgttaaaggaaacattcattttactaaaggatcatagaagttaaagacttaaaacaaactttggcaattaagacagcataccaagaatgcaaatgcctggttgaaatggatcaaatattccatctgcacattaaacaaaagcaattgttatgattgtgcacatggcaggccagaggccctaattgtcccccttccactaaggtggtcctccagtcgaccaggcgtaggctgcgtggtagctcttttctgagattctacagcctggagtaataaatcatgccaagctctctctgctatatcccaaagtccctgcagatcagcacctgaggtccatccagcttctgtctcccaacactaagttcactttgtgtctctcacagcaaggaggagacttagcattccttggagacctgaagggatgcagtaagcttaagaattttcaagagcttatcaatcagtcagccgttgttcatccccaagcagatgtgtggtggtattgtggtggacctttactgggcactctgctgaataactagagtggcacttgtgctttagtccatttggctatccctttcaccctggcatttcatcaaccagaggaaaaacaaaaaataagacatcgtaaagccagagaagccccttataggtctttcaactctcacatctatttagatgcaattggagccccacaaggaataccagatcaatttaaagcttgaaatcaaatagttacaggatttaagtcaatattttagtagatgacagtcaataaaaatgtagattagataaactacatctattacaaccaacagcaacgagcttttcatgagttaaaaagaaaaactcatgttggccccagccctgaggctacctgacctgacaaaactctttacactctatatgtcagaaagagaaaaaatggcagttgaagttttaacccagactgtaaggccctggccaaggccagtggcctatctctcaaaacaactagacgaggtttccaaatggcccccacgtccaagcgccctggtagcaacggccctgttagcacaagaagcagataagctaactcttaggcaaaacctaaacataaagtcctgccatgctgtggtgattttaataaataccaaaggacaccattagctaatgaatgctagactaactagataccaaatcttgctctgtaaaaatccctacataaccattgaagtttgcaacaccctaaccccgccaccttactcctggtatcagagagcccagtttaacataaactgtgtagaggtgttagactcagtttactctagtaggcccaacctccaagaccacccttaaacatcagtagactaggagctgtacgtggataggagcagcttcacccacccctgcaaagtgactctgaaaaagacgacaagccccgctccagtcacactcagaagctga

SEQ ID NO: 25 - DNA, 7434 bp, Homo sapiens
aataaaccatcttggaaggccagaaggtttttgcaaaagcctcaggatagagttatggctgaaggcagcctaatcctcttcgagctatagcaagggtaatttttttttatgtatatactttaagttctggggtacatgtgcacaacatgcaggtttgttacacatgtatacatgtgcaatgttggtgtgctgcaccgattaactcatcatttacattaggtatatctcctaatgctatacctcccccttccacccaccccccaacaggccccggtgtgtgtctatatctctgttttggtaccagtaccatgatatcaagcattttaaactttttatgcttttggttactgtagccttttagtatagtttgaagtcaggtagcatgatgtctccagctttgttcttttggcttaggattgtcttggaaatttgtgttcttttctggttccacatgaactttaaagtagttttttccaattctgtgaagaaagtcattagtagcttgatggggatggcattgaatctataaattaccttgggcagtatggccattttcatgatattgattcttcctatccatgagaatcaaatgttcttccatttgtttgtgtccttttttatttcattgagcagtggtttgtagttctctttgaagaggtccttcgcatcccttgtaagttggattcctaggtattttattctctttgaaacaatggtgaatgggagttcactcatgatttggctctctgtttgtctgttattggtatataggaatgcttgtgatttttgcacattgattttgtatcctgagactttgatgaagttgcttatcagcttaaggagattttgggctgagatgatggagttttctaaatatacaattgtgtcatctgcaaacagggacaatttgacttcctcttttcctaactgaatatcctttatttctttctcctgtcttattgccatggccagaacttccaacactatgttgaataggagtggtgagagagggcttccttgacttgtaccagttttcaaagggaatgcttctagtttttgcccattcagtatgatattggctgtcggtttgtcataaatagctcttattattttgagatatgtcccatcaattcctagtttattgagagtttttagcatgaagggctgttgaattttgtcaaaggtcttttctacatctattgagataatcatgtggtttttgtctttggttctgtttatgtgatggattatgtttattgattttcatatgttgaaccagtcttagcaagggtagttaacataggaatgtagatgctctctactcggggtgggggggcagcaatggtaattaccttcaagtggtgtttacttgagacttttgtcatttaatgtgtgctgaataaatgctggaaaggccagtgagttgggtccaaggttgcaactcttacagcactctcctgggagtctgtaagcagcctggactcttagccagactgaaaagcataatatctgtgtcagtgtacgttattcattcatccttgggtcagggtctgtgggactcacccccgcagctggtgcatgtgtgaggaacgttgtgaaagaagcacaatggaccccccaaaaacggaagtgaaaaggaccatgcggtcagtgagtaatcagtaagtcattggtgtccactagggatttccaagtttggtgggggattgttcaggctaaggtttcatcatgggacaacagttatcagcgcaacagaatcagtatataaaagtattgaaacagctgcttaaggctagtggagcctcggttttgcaggctcaattaagggacttaatgcaaactgttgtaaatcataatccatggttcccaaaggaaggaacgctagatgtagagctctgggaacaagtagggagaaatcttaaacaacatgatgtgcaatggcaatgggtcccagtatcatctttaacactatggggtctagtaaggatggctttggtcccattatacacagaagagcctaaaaagaggaaggaggaggaatagtcacctactttaccgcctccttgtccctcagccccaatatcacagggccaaaataacaaagaggaaatggaggtcttgcctgtgcctcctcctccaataaatagaaaaaaaggcgagagatacattacagctatgcaaccctgtcttaagcaagcggcattagaaggggagctcttagcctgcctggtaatgcaaaatcaatgagccaatcaggtacataaagagttaagaaaaggcattagagaatggagctgtggggccaagtgagcagtagatagaaagaaaggcttggcagcagggaagctcacaaactcaaagccagcaaaagctcccgggaactcagcctgcatggtggggggagggaggggaacacacaagtgagaagcggcacaggtgaaaagcagcgcagacaaaaagtggctcgtttgcaagagcaacgtggccaccgccccggggtccacctgctcagctctccagctttgcaggcggcccacggcaaaatttcatgtgttccttgtatacaagtgacatcccagattataattctctgctaagatttaagtaaaatttaagaatttaaaatacctctttctgataatggccacagctgttatgtctctcctacccctaatgcaactctctccaaatccaatttaagtaaaacagtaacctctgaaaggagagaaattacagaaagcccacaactgcggcaattcttcaagattggcctataatcattattgacttaaaagactgcttttatacgattcccctagcagaacaggacagagaaaaatttgcatttacaataccagctatcaataatgacaagccagcttgtcaatttcattggaaagtgcttcctgaaggaatgctaaacagtcctaccatgtgtcagtatcatgtaaatcaagctttgctctctagtagaaaagagttttctgattgcaagattattcattttatggatcatattgtactagcagccccaatggagccaatgcttttaaatttatacacctctgttgtaaagaatacacagctaagaggtttaatcattgcacctgagaaagtacagatgtcttctccttggagatatcttgggtacatactaacttcctggtcagtaagacctcaaaaggttaaattaaatactagcaacttacacaccttaaatgattatcagaaattactaggcgatattacttggctccgccccaccttaggcatatctaccgataagctgcaaaacctgttttctatcttaaagggcaatccagctgtggattctcccagatatttaacccctccagcaaaaagggaaaccaaggtaatagagcaaaccgtctctcagaggcagctagatcacgttgatcgatggtattcaattcaattgtttatttttcccactaaagactcccatacaggattaataggacagatggcccccgggctacacttcctagaatgggttttttgctcacataccgggactaaaacactatctccctatatttggttacttactaaagtcatctattcaggccacaaatgatgcaatcagttactaggttatgaccctgatgtcatcaggattcctttaagtaaaacacaattcgaagcagtattgccagtatctatcgatctgcaaatagctttctctgattacacaggacaaataaaacatgtcctccctgctgataaaatccttaatttcttatctcatactctggtaatcttgttcacaaaaatagttcactcccccatacctaatgctttaacactgtttactgatggttctggtaaatatggaaaagcagcagtctggtagggaccacataattcaatcactcaatctgggtttgctagcactccaagagctgagactggggctctgatattggccttggaaactttttccactcagcccataaatattgtgagtgactcagcttactctgtttatttattgcagaaccttgaaacagccttaattaagtccactctcgagcccaccctgtgtgctctttttctttgacttcagcaattgctagatcaatgtacacatcctatttttatcacacacattcgagcccacagctctctgccttgcccattattttatggcgataatcaagtagaccttcagattatcacatcactgcttgaccaagccacacaattgcatcaatttttccaccaaaattggagaaacttatctaaacagtttcaacttacccagaggctgggtaaacaaattattctacaatgcccagattgccagctcacaggcaagtcccctccttccacaggtgttaatcctagaggactagaacctaatcaattatggcaaacagatgttacacacatccctgaatttggaaaacttagatatgtacatgtatccattgataccaattctcacttaattagtgcccatgctttgcctggataatcaacccggtatgtcattaaacatcttctaacttttgcgtttatgggacggcccacaaaaattaaaactgataatggtccagcttatgccagctcacaatttcaacaattttgtcacatgtggaatatacaacattccacagacatcccacataacccctaaggacaggccatagaagaatgtgcccactccacacttaaaaatatgctcaaaaaacagaaaagggagagtatgggtaaagaccctgcaacactattggcacaagccttatttacccttaattttctaaatttagatgacaaatttcaatcagctgtagaaaagcgctttgctaaaaccactcaaagcataaaaccttcagttttatggaaagatgtgaacagtaacgtatggtgtggtccaagtgaattattaacatagggaagagggtatgcttgtgttcacaccccctcaggtcccctgtggattccagcacgacacatcaaaccataccatggtgtggctaggacccaacctgatagcagagatgaaggaaccaaccctaccggacccgcagccctggacgatgcagcttccacggacgacacaagccccggatgttacctgggggatgccgaagaggacaactcaggaggctgaacaaattctgcttcagacacagacaccatttactccaggtaatttgctccttgctatgctttctgttgtacattgcaactcacgtagggtattgatcctttttatgctctcgctttgtctgccacctgcacctgctacactctattgggctcattagatctgcctttcttttgccctgtcacctgggcagacaccgccttcccagcctataataatgtgactgcttggctaggagggatagatttacccccagtgggtccctcaataatggcacacattggactaaggtaccagataacactacatatcaccactatcctcccactgtgtgtaagttataaaggctctaaccctagtgcagtggcgcgatctcagctcactgcaagctctgcctcgcaggttcatgccattctcctgcctctgcctcccgagtgagtagctgggactacaggagcccgccaccacgcccggctaatttttttgtatttttagtagagacgaggtttcaccgtgttagccaggatggtctccatctcctgacctcgtgatccacctgcttcagcctcccaaagtgctgagattacaggcgtgagccaccgcacctggccctttttttttttttttttttaaagatggagtttcactcttgttgcccaggctggagtgcaatggcacgatctcggctcactgcaacctccgcctcccaggttcaagcaattctcctgcctcagcctccagaatagctgggattacaggcttgtgccaccacacctggctaattttgtatttttagtagagacggggtttctccacgttggtcaggctggtctcgatctcccgacgtcaggtgatccacccacctcagcttcccaaagtgctgggattacgggcgtgagccaccatgcccggctaggcatctactttttgtacattaatctactcctatcccagttggacctgcaggtgttttcagttttcctcagtgacccaactcttattatggctacatcatggcaaaggaaatgccttaacagccttagctgcaggtagcctaaaaccaggtaatgcaataaatgctgctttcccaaacattctttcctgtgttaaaggacaaagccgggaaagtaattgatttcactttagctaggaggtctgtcatgggggacaagcctgtagcctccagttaggcaattataacattttagactgaagcccccacggccatttgcagggcagccttactaatgtcctcatccatcatggcatcaatcacagttttgtagccacgtcctgttcccctatgatttgggccaatgaggggatgggatatcccagaccccaagtaaaatccatgccaccccaagatattttatggctcctgggacatcttggcacctccattgacacctggcatgggacatatcataattccagtaacaactatactataacctttattcataatcacactgattatgaatttgattatgattatgcctaatttgtactacccatccatatgtttccttatgggaaccaatatttccattacaccccaaaactccgcgtttgtgacccaggtgcagggacaggcttggtttgtgttatatatcactaattacaatatatctgatctaaatgttactagtgtcatggtattaaggagacaatctgaggcattcctaccaatttgacacatgattagcaaggttcctctgcccttgccaccttagaacatgctctataccaggtcagacacaaaagattcatagttacacttacagcctttatagtctttatagtctatagtctttatagcctcagccatagtcatcctggcgactgttagtattgctgtggcatctgttactgagtcagtacaaacagctgcctttgtacatactctggccaaaatgggtctaattaacttctcttacagcagggtatagatcaaaaaattcttgcacgtctgcaagccctcgaggctgcttcggaatatgtgggggagcaacaagatgccctggcattccaacagcaattaaactgcgactgggagcataaacatatctgtgtcacttctctatgatggaatcaatcaatacctagttgggatgaggtgaaacaacacttctggggaacctttcatgataatttaacagcagacataaagcaacttaaaactaaaattttagaattccttcacactatagatctacacacccaacaaacggccatatggaaggatgtgcaagatcacctctccgggttagacccccactcctggggtcactctttga

SEQ ID NO: 26 - DNA, 5698 bp, Homo sapiens
gttaggcctctgagcccaagccaagccatcgcatcccctgtgacttgcacatatatgcccagatggcctgaagtaactgaagaatcacaaaagaagtgaaaaggccctgccccgccttaactgatgacattccaccactgtgatttgttcctgccccaccttaactgagtgattaaccctgtgaatttccttctcctggctcagaagctaccccactgagcaccttgtgacccccgcccctgcccaccagagaacaacctcctttgactgtaattttccattaccttcccaaatcctataaaacggccccacccctatctcccttcgctgactctcttttcggactcaaccgcctgcacccaggtgaaataaacagccatgctgctcacacaaagcctgtttggtagtctcttcacacggacacacatgaaatttggtgccatgactcggatcgggggacctcccttgggagatcaatcccctgtcctcctgctctttgctccatgagaaagatccacctacgacctcaggtcctcagactgaccagcccaagaaacatctcaccaatttcaaatccggtaagcggcctctttttactatcttctccagcttccctcactatccctcaacctctttctcctttcaatcttggcaccacacttcaatctctcccttctcttaatttcaattcctttcattttctggtagagacaaaggagacacgttttatccatggacccaaaactccggtgccggtcacggactgggacggcagccttcccttgatgtttaatcattgcagggacacctctctgattattcacccacgtttcaaaggtgtcagaccacgcagggacacctgccttggtccttcacccttagcggcaagtcccgcttttctggggaaggggcaagtaccccaaccccttctctccttgtctctaccccttctctgcttttctgggggaggggcaagaacccctcaaccccttctccttcacccttagtggcaagtcccacttttctgggggaggggcaagtacccctcaaccccttctccttcacccttagcagcaagtcccacttttctagggggcaagaacccccaatcccttatttccgctccccaacctcttatctctgtgccccaattccttatttccatgccccaaccctttctctgcttttctggagggcaaggaacccctaccccttctctgtgtctctactcttttctctgggcttgcctccttcactatgggcaagattccaccttacattcctcctccttctcccttagcctatattcttaagaacttaaaacctctccaactttcactgacctaaaatctaagcgtcttattttcttctgcaatgccgcttgaccccaatacaaacttgacagtagttccaaacaccggaaaatggcactttcaatttttccatcctacaagatctaaataattcttgtcgtaaaaggggcaaatggtctgaggtgcctgacgtccaggcattcttttacacatcagtcccttcctagtctctgtgcccagtgcaactcatcccaaatcttccttctttccctcccgcctgtcccctcagtcccaaccccaagcgtcgctgagtctttctaatcttccttttctatagacccatgtgacctctcccctcctcaccaggccaagctaggtcccaattcttcctcagcctctgctcctccaccctgtaatctttttatcgcctcccctcctcacacctggtccggcttacagtttccttctgtgactagccctccccaacctgcccagcaatttactcttaaaaaggtgactggagccaaaggcatagtcaaggttaatgctcatttttctttatcccaaatcagaagcgtttaggctctttttcatcaaatataaaaacccagcccagttcatggcttgtgtggcagcaaccctgagatgctttacagccctagaccctaaaaggtcaaaaggccatcttattctcaatatacattttattacccaatctgctcccgacattaaataaaactccaaaaattagaatctggccctcaaaccccacaacaggacttaaccttaccttcaaggtgtacaataataaaaaaaaagttgcaactccttgcctccactgtgagacaaaccccagccacatctccagcacacaagaacttccaaacgcctgaaccgcagcagccaggcgttcctccagaacctcctcccccaggagcttgctacaagtgccagaaatctggccaccaggccaaggaatgcctgcagcccaggattcctcctaagccgtgtcccatctgtgcgggaccccatgggaaatcggactgttcaactcacctggcagccactcccagagcccctggaactctggcccaaggctctctgactgactccttcttggcttagcggctgaagactgatgctgtctgattgcctcggaagccccatagaccatcacggatgctgagctttaggtaactctcagagtggagggtaagtccgtccccttcttaatcaatacgaaggctacccactccacattaccttcttttcaagggcctgtttcccttgcctccataactgttgtgggtattgacagccaggcttctaaacctcttaaaactccccaactctggtgccaacttagacaatactcttttaagcactcttttttagttatccccacctgcccagttcccttattaggccgagatattttaaccaaattatctgcttccctgactattcccggactatagccgcatctcattgctgccgttcttcccaatccaaagcctcctttgcgtcctccttttgtattcccccaccttaacccacaagtataagatacctctactccctccttggcgaccgatcacgcaccccttaccatctcattaaaacctaatcaccctcaccccactcaatgccaatatcccatcccacagcatgctttaaaaggattaaagcctgttatcactcgcctgctacagcatgggcttctaaaacctataaactctccttaccattcccccattttacctgtcctaaaaccagacaaggcttaaaagttagttcagaatctgcgccttatcaaccaaattgttttgcctatccaccccgtggtgccaaacccatatactctcctatcctcaaaacctccgtctacaatccattattctgttctggatctcaaacatgctttctttactattcctttgcacccttcatcccagcctctctttgccttcacttagactgaccctgacacacattaggctcagcaaattacctgggctgtactgccgcaaggcttcacagacagcccccgttacttcagtcaagcccaaatttcatcctcatctgttacctatcttggcataattctcataaaaacacaggtgctctccctgctgatcatgtccaattaatctccaaaacctcaatcccttacaaaacaacaactcctttccttcctaggcatggttagtgtggtcagaattcttacacaagagccaggaccacaccgtgtagcctttctgtccaaacaaattgaccttactgtcttagcctagccctcatgtctgcatgcagcggctgccgctgctttaatactgttagaggccctaaaaaatcacaaactatgctcaactcactctctacatttctcgtaacttccaaaatctattttcttcctcatacctgacgcatatactttctgctccccagctccttcagctgaactcactctttaagtcccacaactaccattgtttctggcccggacttcaatctggcctcccacattattcctgataccacacctgacccccatgactgtatctctctgatccacctgatattcaccccatttccccatatttccttctttcctgtccctcaccctgaacacacttggtttattgatggcagttccaccaggcctaatcgccacacaccagcaaaggcaggctatgctatagtacgagccactagcccgcctctcagaacctctcatttcctttccatcgtggaaatctatcctcaaggaaataacttctcagtgttccatctgctattctactactcctcagggattattcaggccccctcccttccctacacatcaagctccaggatttgcccccacccaggacgggcaaattagctttactcaacatgtcccgagtcaggaaactaaaatagctcttagtctaaatagacgctttcactgaataagtaatggcctttcctacagggtctgagaaggccaccacagtcatttcttcccttctgtcagacataattcctcagtttagccttcccacctctatacagtctgataacagaccagcctttattagtcaaatcagccaagcagtttttcaggctctcagtattcagtgaaacctttatatcccttatggtcctccgtcttcaagaaaagtagaacggactaaaggtcttttaaaaacacacctcaccaagctcagccaccaacttaaaaaggactggacaatacttttaccactttcgcttctcagaattcaggcctgtcctcagaatgctacaaggtacagcccatttaagctcctgtatagacgctcctttttattaggccccagtctcattggacaccagaccaacttagactgtgccccaaaaaaacttgtcatccctactatcttttgtctagtcatactcctattcaccattctcaactactcatacatgccctgctcttgtttacactgctggtttacactgtttctccaagccatcacagctggtatctcctggtgctatccccaaactgccactctaaactcttgaagtaaataaataatctttgctggcaggactatggtgaatctccttaggcactctctaatcagatgtcctagctctcccaattcttagactttttatacctgtttttctccttctcttattccatttagtttttcaattcatacaaaaccgtatccaggccatcaccaatcattctatatgacaaatgtttcttctaacaaccccacaatatcaccccttaccacaagacctcccttcagcttaatctctcccactctaggttcccacactgcccctaatcctgttgaagcagccctgagaaacatcgcccattctctctccataccacccccaaaaattttcgccgccccaacacttcaacactattttgttttatttttcttattaatataaggaagcaggaatgtcaggcctctgagcccaagccaagccgtcgcatcccctgtgagttgcaggtatacgcccagatggcctaagtaactgaagaatcacaaaagtgaaaaggccctgccccgccttaactgatgacattccaccattgtgatttgttcctgccccaccttaactaagtgattaaccgtgtgaatttccttctcctggctcagaagctcccccactgagcaccttgtgaccccgcccctgcccaccagagaacaaccccctttgactgtaattttccattaccttcccaaatcctataaaacggtcccacccctatctcccttcgctgactctctttttggactcagcccacctgcacccaggtgaaataaacagccatattgctcacacaaagcctgtttggtggtctcttcacacggacccgcatgaaa

SEQ ID NO: 27 - DNA, 1841 bp, Homo sapiens
aggccttttcaaaactatcaagcagacagtcagggcctgtgaagcgtgccaaagaaataatcccctgccttatcactaagctccttcaggagaacaaagaacaggccattacccaggagaagactggcactagattttacccacatgcccaaatctcagggatttcagtatctactattctgggtagatactttcactggttgggcggagtccttcccttgcaggacagaaaaggcccaagaggtaataaaggcactaattcatgaaataattcccagattcggacttccccgaggtttacagagtgaaaatggccccgctttcaaggctgcagtaacccagggagtatcccaggcattaggcatacagtatcacttacactgcgcctagaggccaaaatcctcaagaacagtcgagaaaatgaacgaaacactcaaacaacatctaaaaaagctaacccaagaaatccaccttgcatggcctgctctgttgcctttagccttactaagaatccgaaactctccccaaagagcaggacttagcccatacgaaatgctgtatggacagcccttcctaaccaatgaccttgtgcttgaccaagagacagccaacttagttgcagacatcacctccttagccaaatatcaacaagttcttaaaacattacagggaacctgtccccaagaggagggaaaggaatttttccaccctagtgacatggtattagtcaagtcccttccctctaacttcccatccctagacacatcctgggaaggaccctacccagtcattttatctaccccaaccgcagttaaagtggctggagtggagtcttggatacatcgcactcgagtcaaaccctggatactgccaaaggaacccaaaaatccaggcgacagtgctagctattcctgtgaatctctagaggatctgcgcctgctcttcaagcaacaaccttgaggaaagtaactagaatcgtagatcctcgtggccctcccttgttgtatttttctttttactgttctcttaccccctttcactctcactgcacctcctccatgctgctgtactaccagtagctccccttaccaagagctcctatggagaatgcagcttcccggaaatattgacgccccatcgtataggggtttttctaaaggaaaccccactttcaccacctacacccatatgcccctgcactttaggccatacatttcaatccctgtatctttaacctccttgttaagtttgtctcttccagaatcaaagctgtaaaacaacacatcgttcttcaaatggagccccagatgcagtccatgactaagatctaccgcggatccctggaccagcctgctagcccatgctccgatgttaatgacatcgaaggcactcctcccgaggaaatctcaaatgcacaacccctactatgccccaattaagcaggaagcagttggagcagtcgacggccaacctccccaacagcacttgggttttcctgttgagagggggtactgagagacaggactagctggatttcctaggccgactaacaatttctaagcttaggtggggaaggtgactgcacctacctttaaacacaggacttttgtaactcagctcacatctggccaatcaggtagtaaagagagctcattaaaataccaattagtctaaaaacaggaggtaaagaaataaatcatctctcgcctgacagcacagaggaaggggcaatgattgggatataaaccccaggcattcgagctgggagtgggcaaccccctttgggtcccctcccattgtatgggagctctgttttcactctattcaatcttgcaactgca

SEQ ID NO: 28 - DNA, 83 bp, Homo sapiens
gtgaggcctctgagcccaagctaagcctgtgacctgcacatatacacccagatggcctggagcaactgaagaaccacaaaaga

SEQ ID NO: 29 - DNA, 6005 bp, Homo sapiens
gtcaggcctctgagcccaagctaacccatcatatcccctgtgacctgcacatatagatccagatggcctgaagcaagtgaaggatcacaaaagaagtgaaaatggctggttcctgccttaactgatgacattaccttgtgaaattccttctcctggctcagcagctcccccattgagcaccttgtaacccccgcccctgccaccagagaacaacccctttgactgtaattttccactacctacccaaatcctataaaacggccccacccctatctccctttgctgactctctttttggactcagcccgctggcacccaggtgattaaaaagctttattgctcacacaaagcctgtttggtggtctcttcacacggacgcacatgacatttggtgccaaagacctgggacaggaggactccttccagagacttgtcccctgtcctcgtcctcactccgtgaggagatccacccacgacctcaggtcctcagaccaaccagcccaaggaacatctcaccaatttcaaatcggttaagcggtcttttcactctcttctccagcctctcttgctacccttcaatctccctctctcgctatccttcaatctccctgtccttccaattccagttttttttcctctctagtagagacaaaggagacacatttcatccgtggacccaaaactctggtgctggtcacggacttgggaagacagccttcccttggtgtttaatcactgtggggacgcctgcctgattattcacccacactccattgttgcctgatcaccatggggatgcctgccttcattcacccacattcacttggtggcatgtcaatggtgggaatgcctgctttggctgctcacccacactgcagcccagggctgctcaccaccccccttctccatgtctctaccctctcttttctctgggcttgcctccttcactatgggcaaccttccaccctctattcccccttcttctcccttagcttgtgttctcaaaaacttaaaatctcttcaactcacacctgatctaaaacctaaacaccttgttttcttctgcaatgccacttgaccccaatacaaactcgacaattgttccaaatagccagaaaatccactttcaatttctccatcctacatgatctagatagttcttgtcataaaatgagcaaatggtctgaggtgcctgacgtccaggcattcttttacacatcagtccctccctagtctctgttcctaatgcaactcatcccaaatcttccttctttccctctcgcccgtcccctcagtcccaaccccaagcgtcactgagtcttttcaatcttccttttctaccaaccaatctgatctctcccctcttccccagagtgctcctcctcagtttgctccccgccaggctgaatcaggctccaattcttcctcggcctccactccccgacactataatccttctatcacctcccttccttacacctgctctggcttacagtttcattctgagactagccctcccccacctgcccaacaatttcctcttaaagaggtggctggagctaaaggcatagtcaaggttaatgctccttttctttatctgacctctcccaaagcagttagtgtttaggctctttttcatcaaatgtaaaaatccagcccagtttatggcttgtttagcagcaaacttgagaccctttaccaccctagaccctaaaaggtcagaaagccgtcttattctcaataagcattttattacccaatccgctcccgacattagaaaaagctccaaaaattagattccggccctcaaaccccacaacaggacttaactaacttcaccttcaaggcatacaataatagagttagaggcggccaagtagcaacatatttctgagttgcaattccttgcctccactgtgagagaaaccccagccacatctccagcacacaagaacttcaaaacgcctaagccacagtggtcaggcattctttcaggacctcctcccccaggatcttgcttcaagtgccggaaatctggccactgggccaaggaatgcccgcagcccgggatacctcctaagccatgtcccatctgtgcagaaccccactggaaatcggacagtccaactcacccatcagtcactcccagagcccctggaactctggcccaaggctctcggattgacgccttcccagattttctcagcttagcggctgaagactgacactgcccgattgcctcggaagtctcctggaagcctcctggaccatcacatatgctttgggtaactcttacattgagaggtacatctgtcaccttcttaatcaatatggaggctacccactccacattaccttcttttcaagggcgtgtttcccttgcctccataactgttgtgggtactgacgtctgggcttctaaatctcttaaaactccccaactctgatgccaacttggacaatattcttttatgcactcctttttagttatccccaccttcccagctcccttattagactgacacatcttaagcaaattatctgcttccctgatgccacccttcttcccaacccaaagcctccttcacatcttcctctcatatccccctacttctactacctccctggcaactgatcacatgtccattactatcccattaaaccctaatcaccattaccttgctcaacaccagtatcctatcccacaacaggctttaaggggattaaagcctgttatcactcacctgctacagcatgggcttctaaaacttataaactctccttacaattcccccattttacctattcaaaaaccagacaagtcttacaggttagttcaagatctgcgccttatcaaccaaactgttttgcctatccaccctctggtgcccaacccgtacactcttttgccctcaataccttcctccacaactcactattccattcttgatcttaacgatggttttttcactattccactgcacccctcatcccagcctctctttgcctttaccctgacacccatcagtccctgcaaattacctgggctgtactgctgcaaggcttcagggacagccctcattacttcagccaagctctttctcatgatttactttctttccactcctccacttctcaccttattcaatatgttgatgacctactttgtagccctgcctttgaatcttctcaaaaagacaccctcctgctccttcaacatttattctccatgggatatcaagtatctccttccaaagctcaaatttcttctccatccattacctaacttggcatagttcttcatgaaaacccacgtgctctccctgctgatcatgaccaactgatctctcagaccccaaccccttctacaaaacaacagctcctttccttcctgggcatgattggatactttcacctttggatacctgcttttgccatcctaacaaaaccatcacataaactcacaaaaggaaatttagctgaccccatagatcctaaatcctttgcccactcctctttccgttccttgaagacagctttagagactgctcccacactagctctccctgactcatcccaacccttttcattacacacagccaaagtgcagggctgtgcagttggaattcttacacaaggaccaggaccacaccttgtagcctttttgtccaaacaacttgaccttactgttttaggctggccatcatgcctccgtgcggcagctgctactgccataacacttttagaggccctcaaaatcacaaactattctcaacacactctctacaattctcataacttccaaaatctattttcttcctcacacctggtgcgtatgctttctgctacccggctccttcagctatactcaccctttgttgagtctcccacaattactattgttcctggcctggacttcaatccagcctcccacattattctgaataccacacttgacccccatgactgtatctctctgatccacttgacattcattccatttccccatatttccttctttcctgttcctcaccctgatcacacttggtttatcgatggcagttccaccaggccaaatcaccactcaccagcaaaggcaggctatgctatagtatcttccacatctatcattgaggctaccgctctgcccccctccactccctctccgcaagccgaactcattgccttaactagagccctcactcttgcaaagggactacacatcagtatttatactgactctgaatattccgtccatatcctgcactaccatgctgttatatgggcagaaagaggttgcctcactatgcaaaggtcctccatcattaatgcctctttaatgaaaactcttctcaaggctgctttacttccaaaggaagctggagtcatatactgcaagggccatcaaaaggcatcagatcccatcgctcaggacagtgcttaggctgataaggtagctaaagaagcagctagtgttccaacttctgtccttcagtgccagtttttctctttctcactggtcactcccacctattcccccactgaaacgttcacctatcaatctcttcccacacaaggcaaatggttcttggaccaaggaaaatatctccttccagcctcacaggcccattctattctgtcgtcatttcaaaacctcttccatttaggttacaagccactagcccgcctcttagaacctctcatttgctttccatcatggaaatctatcctcaaggaaatcacttctcagtgttccatctgctcttctactactcctcagggattactcaggccccctcccttccctacacatcaggctcagggatttgcccctgcccaggactggcaaattgactttactcacatgccatgagtcaggaaactgaaatacctcttggtctgggtagacactttcactggatgggtaaaggcctttccctcagggtctgagaagtccactgcggtcatttcttcccttctgtcagacataattcttcagtttgggcttcccacctctatacagtccaataacggaccggcctttattagtcaaatcacccaagcagtttctcagtctcttggtattcagtagaaccttcataccccttaccaacctcaatctttaggaaagatagaacggactaatgatcttttaaaagcacacctcaccaagctcagcctccaacttaaaaaggaggactctgtcaaggatagagcccaaaaactcaccaaccaagcaagtaattacactgaaccccttggacactctctaattggatgtcctgggtcctcccaattcttagtcctttaatacctgttttcctctttctccttgtgtcttctgtctagtttctcaattcatacaaaactgtatccaggccatcaccaaccattctatacaaccaatgtcacttctaacaaccccacaatatcaccccttaccacaaaatcttccttcagctaaatctctcccactctaggctcccacattgcccctaatcccactcgaagctgccctgagaaacattgaccattatctctccataccacccccccaaaatttttgctgctctaacacttcaacattagtttatgttatttttcttattaatataagaagacaggaatgtcaggcctctgagcccaagctaagccatcatatcccctgtgacctgcacatatagaatcagatggcctgaagcaagtgaagaatcaccaaagaagtgaaaatggcctgttcctgccttaactgatgactttaccttgtgaaattacttcccctggctcagaagctcccccattgagcaccttgtgacccctgcccctgtccgccagagaacaacccttttgactgtaattttccactacctacccaaatcctataaaatggccccacacctatcttccttcactgactctctttttgaactcagcctgcctgcacctaggtgattaaaaagctttattgctcacacaaagcctgtttggtagtcacttcacacaga

SEQ ID NO: 30 - DNA, 846 bp, Homo sapiens
agcagctcattgagaacgggccaggatgacaatggcggctttgtggaatagagaggggagaaaggtggggaaaagattgagaaatcggatggttgccgtgtctgtgtagaaggaggtagacatgggagacttttcattttgttctgtactaagagaagttcttctgccttgggatcctgttgatctgtgaccttacccccaaccctgtgctctctgaaacatgtgctgtgtcaaactcagggttaaatggattaagggcggtgcaagatgtgctttgttaaacagatgcttgaaggcagcatgctccttaagcgtcatcaccactccctaatctcaagtacccagggacacaaacactgcagaaggccacagggacctctgcctaggaaagccaggtattgtccaaggtttctccccatgtgatagtctgaaatatggcctcttgggaagggaaagacctgaccgtcccccagcccgacacctgtaaagggtctgtgctgaggaggattagtataagaggaaggcatgcctcttgcagttgagacaagagcaaggcaactgtctcctgtccgtccctgggcaatggaatgtctcggtataaaacccgattgtacgttccatctactgagatggggaaaaaccgcctatctcacctatcaccgcctatcaccactccccaatctcaagtacccagggacacaaacgctgcggaaggccgcagggtcctctgcctaggaaaaccagagacctttgttcacttgtttatctgctgaccttccctccactattgtcctatgaccctgccaaatccccctctgtgagaaacacccaagaatgatcaataaa

SEQ ID NO: 31 - DNA, 477 bp, Homo sapiens
agaccactactactcctgctgtcctcctccccctaccttgcctagttcacaagacaggaggagagaaaaagcaaaaagttggaaaaaaacaaaagtaagataaatagccagacaacctgggcgccaccacctggccctaggagttaaaaaaagtaataataataacatcaacccctgacctaaactgcttgtgttatctgtaaattccagacactgtatgaaaaaagcattgtgaaactttttttctgttagctgttgcatgtagcccccagtcacgtttcccacgcttgcttgatgtatcgcgaccattttgcgtggaccccttaaagttgtaagcctttaaaaaggccaaggatttcttttttggggagctgagctcttaagacgcgagtctgctgacgctcctggctgaataaaaacctcttccttctttaatctggtgtctgaggagttttgtctgcggctcatcctgctaca

SEQ ID NO: 32 - DNA, 451 bp, Homo sapiens
gtcaggcctctgagcccaagccaagccatcgcatcccctgtgacttgcacgtatacgcccagatggcctgaagtaattgaagaatcacaaaagaagtgaaaatgcgctgccttgccttaactgatgacattccaccacaaaagaaatgaaaatggcctgttcctgccttaactgatgacattatcttgtgaaattccttctcctggctcatcctggctcaaaagctcccctactaagcaccttgtgacccccactcctgcccgccagagaacaacccccctttgactgtgattttcctttacctacccaaatcttataaaacggccccacccctatctcccttcgctgactctcttttcggactcaggccgcctgcacccaggtgaaataaacagccttgttgctctcacaaagcctgtttggtggtctcttcacaaggatgcaagtgaaa

SEQ ID NO: 33 - DNA, 1700 bp, Homo sapiens
gttacaataatacagggaagagatcttactgtgtggacatctcatgatgtgaacggcatactcactgctaaaggagacttgtagctatcagacaaccatttacttaaacatcaggctctgttacttgaagggccagtgctgcgactgcacacttgtgcaactcttaacccagccacatttcttccagacaatgaagaaaagatagaacataactgtcaacaagtaattgctcaaacctatgccactcgaggggaccttttagtgtttcccttaactgatcctgacctcaacttgtatactgatggaagttcctttgtagaaaaaggacttcaaaaagcggggtatgcagtggtcagtgataatggaatactttaaagtaatcccctcactccaggaactagtgctcagctggcaaaactaatagccctcactcgggcactagaattaggagaaggaaaaagagtaaatatatatacagactctaggtatgcttacctagtcctccatgcccatgcagcaatatggagagaaagggaattcttaatttcgagggaacacctatcaaacatcaggaagccattaggagattattattggctgtacagaaacctaaagaggtggcagtcttacactgctggggtcatcagaaaggaagggaaagggaaatagaagggaactgtcaagcagatattgaagccaaaagagccacaaggcaggaccctccattagagatgcttatagaaggacccctagtatggggtaatcccctccaggaaaccaagccccaatgctcagcaggagaaatagattggggaacctcatgaggacacagttttctcccctcaggatggctagccaccaaagaaggaaaagtacttttgcctgcagctaaccaatggaaattacttaaaacccttcaccaaatctttcacttaggcattgatagcacccatcagatggccaaattattatttactggaccaggccttttcaaaactatcaggcagatagtcagggcctgtgaagtgtgccaaagaaataatcccctgcactgcaggccatacatttcaatccctatatctttaacctccttgttaagtttgtctcttccagaatcaaagctgtaaaactacaaatcgttcttcaaatggagccccagatgcagtccatgactaagatctaccgtggacccctggaccggcctgctagcccatgctctgatgttaatgacattgaaggcacccctcccaaggaaatctcaactgcaccacccctactatgccccagttcaacaggaagcagttagagcggtcttcggccaacctccccaaaagcacttgggttttcctgttgagaggggggactgagagacaggactagctggatttcctaggccgactaagaatccctaagcctagctgggaaggtgaccgcttccatctttaaacacggggcttacaacttaactcacacatgaccaatcagatagtaaggagagctcactaaaatgctaattaggcaacaacaggaggtaaagaaatagccaatcacctgttgcctgagagcacagcgggagggacaatgatcgggatataaacccaggcattcaagccggcaacagcaaccccctttgggtcccctccctttgtatgggagctctgttttcactctacttcactctatcaaatcttgcaactgca

SEQ ID NO: 34 - DNA, 6222 bp, Homo sapiens
actgaagaaccacaaaataagtgaaaatggctggttcctgccttaaccgatgacattccaccattgtgatttgttcctgccccatcctaactgatcaattgatcttgtgaaattctttctctggacaatgaatctcggaagctccccattcagcaccttgtaacccctgcctctgtctgcaagagaaaaaccccctttgactgtaattttccactaccctcccaaatcctataaaactgccccacccctatctacctttttcggactcagtctgcctgcacttgggtgattaaaaagctttattgctcacacaaagcctgtttgttgggctcttcacacggacacacgtgacatttggtgctgaagatctgggacagggggattccttcaggagaccagtcccctgtcctcaccctcactccatgagaagatccacctatgaccttgggtcctcaggccagcccaaggaacatcttaccaatttcaaatcgggcaagcggtcttttcactctcttctccagcttctctcgctacctttcaatctccctgtccttccaattccagttctttttcctctctaatagagacaaaggagacacattttatctgtggacacaaaactccagcgtgggtcacggacttgggaagacagtcttcccttggtgtttaatcaccgtgtggatgcctgccctgatcattcacccacattccactggtgtctgatcactgtggggatgcctgcctgattattcacccacattccactagtgtctgatcactgtggggatgcctgcctgattattcacccacattccactagtgtctgatcactgtggggatgcctgcctgattattcacccacattccactagtgtctgatcactgtggggacgcctgccttggtcattcacccacattcccttggtggcaaatcaattgtggagacgcctgctttggctgctcacccacattacagcccagggctgctcaccacccccttctctgtgtctctacctttctctttaaacttacctccttcactatgggcaagcttccaccctccattcccccttcttctcccttagcctgtgttctcaagaacttaaaacctcttcatctcacgcctgacctaaaaccttactgccttattttcttctgcaacactgcttggccccaatacaaactcaacaatggttctaaatggccagaaaacagcacttttgatttctccatcttacaagacctggatgatttttcttgaaaaatgtgcaaatggtctgagatgcctgacatccaggcattcttttacacatcagtccctccctagtctctgctcccagtgcgactcatcacaaatcttctttctctcctgtctgttccttcagtctccaccccaagctctgagtcctttgaatcctccttttctatggacccatctgacctctcccctcctcaccaggctgctcctcaccaggctgagccaggtcctaattcttcctcagcctccactccccagccctataatccttctatcacctccccctcctcccaccctgtctggcttatagttttgttccacgactagccctccccaacctgcccaacgatttcctcttacagaggtggctgcagctcaaggcagagtcaaggttaaccctcctttttctttatctgacctctctcaaatcagttagtgttcaggctctttttcgtcaagtataaaagcccagcccagttcatggcctgtttggcaacaacccttagatgctttgccgccctagacccagaggggccagaaggccgtcctattctcaatatgcattttactactcaacccactcccaacattagaaaaagctccaaaaattagattctggccctcaaaccccacaacaagacttaatcaatctcgccttcaaggtgtacaataatagagaagagtcagccaagcggcaacttatttctgagttgcaattacttgcctccactgtgagagaaaccccagccacatctccagcacacaagaacttcaaaatacctaaaccacagtggccaggcattcctccaggaccttctcccccaggatcttgcttcaagtgctggaaatctggccactgggccaaggaatgaccacagcctgggattcctcctaagccatgtcccacttgtgcaggaacccactggaaataggactgtccaacttgcctggaagccactcccagagcccctggaactctggcccaaggctctctgactgactccttcccagatcttctcagcttagcggctgaagactgacacagcccaatcacctcggaagcctcctggaccatcacagatgctttaggtaactcttagagtggagtgtaagtccatacccttcttaatcaatacggaggctacccactccacattaccttcttttcaagggcctgtttaccttgcccccataactgttgtggatattgatggccaggctgctgggccctttaaaactcccccactctggtgtcaacttggaaaacagtcttttatgcctcttttttagttatccccatctgcccagttcccttattagatcaagacattttaagtgaattatctgcttctctgactattcctgggctacagccacatctcattgctaccctttcccctgttcaaaacctccttcatgtcttcctcttgtatcccctgcacctgaacccacaagtatgagacaactctactccctccctagcaattgaccacatgcccattactatcccattaaaatctaatcatccttaccctgctcaacaccagtatcccatcccacaacaggctttgagaggactaaagcctgtccaggatcttcaccttatcaaaaaaattgtcttgcctatccaccccgtggtgccaaacccatatactctcctatcctcaatacctccctccacaaccccttattctgttctggatttcaaagatgctttctttgctattcctttacacccttcatcccagcctctcttcgctttcatttggactgaccctgatacccatcagtctcagcaacttacctgggctgtactgctgcaaggcttcagggacagcgcccattacttcagtcaagccctttctcatactttactttctttctgtccatctgcttctcaccgtattcaatattttgacaaccttctactttatagcccctcctacagatcttcccaacaggacatcctcctgctcctccaacatctattctcaaaaggataatgcaactcccccgtcaaaggccaaatttcttcctcatccattacctatctcagcataactcttcataaaagcacatatgctctccctgttgatcgtgtccggctaatctcccaaaccccaaccccttctacaaagcaacaactcctttccttcctaggcatagttaggtactttcgcctttggatatctgtttttgccatcctgactaaaccatcatacaaaaggaaacctagctgaccccatagatcctaaatcctttccccactcgtctttccgttccttaaaaactgtcctaaaagctgctcacacactagctctccctaactcatcccaacccttttcattacacgcagccaaagtacaggactgtgcagtcagaattcttacacaagagccgggactgcactctgtagcctttctatccgaacaacctgaccgcacagttctgagctggccttcatgtctgtatgcagtgacagccaccgctttaatacttttagaggccatcaaaatcacaagctatgctccatttactctacagttcccataactttcaaaatccattttcctcctcacacttgatgcgtatactttctgctccctagctccttcaactgtactcactatttgttgaatctcccacaattaccattgttcctggcctggacttcaatctggcctcccacattattcctgctaccacacctgacccccatgattgtatctctctgatccacctggcattcactccatttccccatatttccttctttcctgttcctcaccctgatcacacttggtttattgatggcagttccaccaggcctaattgccactcaccagcaaaggcaggctatgctatagtatcttccacatctatcattcaggctactgctccgccctcctccactacctctcagcaagccaaactcattgccttaactcaggccctcactcttgcaaagggactacacgtcaatatttatactgaccctaaatatgccttccatatcctgcaccaccatgctgttacatgggctgaaagagttttcctcaccatgcaagggtcctccatcgttaatgactctttaataaaaactcttctcaaggctgctttacttccaaaggaagctggagtccttcactgcaaaggccatcaaaaagcctcagaccccattgctcaaggcaacaattatgctgataagacagctaaagaagcagccagtattcctacttatgtccctcatggccagtttttctccttctcatcagtcactcctactcactctcccactgaagtttccacctatcaatccctccctactcaaggcaaatagttctttgaccaaggaaaattcctccttccagccttacagctcattccattctatcgtttttcataacctcttccatgtaggttacaagccactagccctcctcttagaacctctcatttcctttccatcatggaaatctatcctcaaggaaatcacttctcagtgttccatttgctattctcccactcctcagggagttcgcccctgcccaggattggcagattgactttacccacatgccccgagtcaggaaactaaaatacctcttggtctgtgcagacactttcactggatgggtagaggcctttccctcagggtctgagaaggccaccgcggtcatctcctcccttctgttgacataattcctcaatttagcctcccgctctacccagttgtcccatcaatccccattacaacttctaatggctgctgccctagctggatccctagtgttagatatgagttctaaatttcttttcaaagaatcaatatgtcagtaggttcaattctttgccttctacttttaaacttaacttcctcgtaaagcaaactttttcaattacctgctccaccctgactcatttcaatcacctgctccaccctgactcattccgattacctgctccaccctgactcattctgattacctgttccaccctgactcattccaatgacctgctgtcataaccatttttcctgccaaaccactcaccctgtcactctctttaaattagccaattgaaattagtttagcctgtgcggtctaaccctagccaataggggaaggacgcagcagcaggggccacgtgcatcagggataagaaccccttcccgtcccttgtccaagtgtgtgctcaccattgctccatctgtaagggtgcaaccttctatagaagtaacttgccttgctgagaattaaaaagaaaattttatattcgagtgctatttcttttgtggcacagaaacttcatatataatactaggagtctgggtacaagacacctcttttagtgctctttctcattttttcactttgcatttccagtgttgcacaaggtctcttcttctgtgactcctctacctacatgtgtctacctgctaataggacaggcacgtgcacactagttttccttactcccaaaattcaatttgcaaataggactgaacagcttcctcttcccctcatgacaccaacacttcaccactattttgttttatttttcttattaatatagaagacaggaataggcctcgacttactgctgaaaaaggagaactctgtatatttttaaatgaagagtgttgtttttacccaaatcaatctggcctggtgtatgacaacataaaaaaactcaaggatagagtccaaaaacttgccaaccaagcaaataattacgctgaaccgccttgggcactctctaactggatgtcctggttcctcccaattcttagtcctttattacctctttttctccttctcttattcagaccttgtgtcttctgtttagtttctcaattcacacaaaaccacatccaggccatcaccaatcattctatatgacaaatgctccttctaacaaccccacgatatcaccccttaccccaaaatctttcttcagtttaa

SEQ ID NO: 35 - DNA, 7050 bp, Homo sapiens
cccttttgggtcccctccctttgtatgggagctctgttttcactctattaaatcttgcaacttcacactcttccagtctgtgtttgttatggctcaagctgagctttcgctcgctgtccaccactgctgtttgctgccatcgcagacccgccgctgacttccacccctctggatccggcagggtgtccactgcacctctggtccagcgaggtggtgcccattgccgctcccaatcgggctaggggcttgccattgttcctgcacgggctaagtgccctgggttcatgctaattgagctgaatagagctgtaacactcactgtatggcccaaggttccattccttggaatctgtgaggccaagaaccccaggtcagagaagaagaggcttgccgccatcttggaagcagcccgccaccatcttgggagctctaagaacaaggaccccccggtaacattttggccaccatgaagggacttccaaagcggtgagtaatatgggaccacttttgcttgctgttctgccctattcttcattggaattggaggaaaataccgggcacctgtcagctggttaaaaacaattagcatggccaccagacttaagactcaggtgtgaggctgtctggggaagggctgtctaacagcccccaacccttctgggttgggagcgttgggctgtctggaaccagcttccactttcagttttcctggggaagctgagggccgactagaggcagaaagctgttgtcctgaactcctggtgttagctggttgagatcatggcgcagccagaagtctctactcaacagtcagccatgcgtgcacccctacctttccttctgacctatacctcttggtcctgaccacaacttgcttgaaagtgtagccccaaaattctccttacctctgaatctacttcctccaatccctgcctcctaggtactaatggttcagaccttcatttcctctagcaagctgtatctccaaagggatctaaggaagctctatgctgtgtccttaagcccctaggctctgaacccagatagtcttgtccctggtgtccctcccaatttaggcatacagctctcaacatgggcagttatgtaggacctgttccccaccatccttgccagggtcccaggtttgtaaagggctaggagaagagagagagagagagagacagagacagaggggagagaaagagagagagacgaagagggagtcaaagagaaaaagaaagagaaagatagaagtagtaaagaaaaaatagtgtgccctattcctttaaaagccagagtaaatttaaaacctataattgataattgaaggtcttctcctgaccctgtaacactccaataccactttattgtcagtgtaaacaagggggtagcccaaaaacactgagaccactgacaacctatcaaaatcctatcaaaaatccgtaacccagtaacacgtggatgggccaaaggcattcagtcggtagcggcaactgctttgctaaaagtagaaaaataactttagaggaaacctcattgtgagtacacctcaccagttcaaaactatcctaagtcaaaaaagcaaaaaggtaacttactaactcgaaaatcttaaaatatggggctcttctgttagaataaaggtaacttattaaccactgaaaattcccttaacccagcagatttcctaacaggggatttaaatcttaattaccatacaaaggtccgacagatctaggaggaactcccttcaggacaggatgatagatggttcctcccaggtaattgagggaaaaaaccacaatgggtatttagtaattgatagggaaactcttgtagaagcagagttaggaaaattgcctaataattggtctgctcaaacatgcgagctatttgcactcagccaagccttaaagtgtttacagaatcaaaaaaactcaatctcaatcctgactcaaaaggttacctacaccctctctgaaatgaatttgcataagaactgttgtttatgggaatgcatcttgatggggcaactgggttgttatgaaatactcaggaacccagcccagctccaggactcacccctgagcaaaaaagcaatgttgggcactctggtaaaggaccactagaatccagcagcctggacccctttctttgtggtcaagaaaggcaggaaaaggggtgcaggactgctacatcagtgagtgcaactaatctgataagcagaggtccatgggtggttacacaccctggaaaggaataaacattaggaccatagagaacgctctaggactaatgctcattggaaaatgactaggggtgctggcatccctatgtccttttttcagataggaaatgttccccccaaggcaaaaatgcccgtaagatatattctggagaattgggaccaatttgactctcagatgctaagaaagaaatgacttacattcctctgcagtaccacctggccatgatgtcctcttcaagggggagaaacctggcctcctgagggaagtataaattataacaccatcttacaactagacctcttttgtagaaaagaaggcaaatggagtgaagtgccatatgtacaaactttcttttcattaagagacaacttgcaattatgtaaaaagtatgatttatgccctacaggaagccctcagagtctacctccctaacctgatgtccccctgactccttccccaactaataaggacccccctttcaacccaaacagtccaaaaggacatagacaaaggagtaaacaatgaaccaaagagtgccaatattccctggttatgcaccctccaagcggtgggagaagaattcggcccagccagagtgcatgtacctttttctctctcacacttgaagcaaattaaaatagacctaggtaaattctcagataaccctgatggctatattgatgttttacaaggattaggacaatcctttgatctgacatggagagatataatattactgctaaatcagacgctaacctcaaatgagagaagtgctgccataactggagcccgagagtttggcaatctctggtatctcagtcaggtcaatgataggatgacaacggaggaaagagaacgattccccacagggcagcaggcagttcccagtgtagctcctcattgggacacagaatcagaagatggagattggtgccgcagacatttgctaacttgcgtgctagaaggactaaggaaaactaggaagaagcctatgaattattcaatgatgtccactataacacagggaaagaaagaaaatcctaccacctttctggagagactaagggaggcattgacaaagcatatctctctgtcacctgactctattgaaggccaactaatcttaaaggaaaagtttatcactcagtcagctgcagatattagaaaaaaacttccaaagtccgccttaggcccggagcaaaagttagaaaccctactgaacttggcaacctcggttttttataatagagatcaggaggagcaggcagaatgggacaaatgggataaaaaaaaaaaggccactgctttagtcatggccctcaggcaagcggactttggaggctctggaaaagggaaaagctgggcaaatagaatgcctaatagggcttgcttccagtgcggtctcaaggacactttaaaaaagattatccaaatagaaataagccactcccttgtccatgccccttatatcaagggaatcactgtaaggcccactgccccaggggacgtaggtcctctgagtcagaagccactaaccagatgatccagcagcaggactgagggtgcctggggcaagcaccagcccatgccatcaccctcacagagccctgggtatgcttgaccattgagggccaggaggctaactgtctcctggacactggtgtggccttctcagtcttactctcctgtcccggacaactggcctccatatctgtcactatcccaggacagccagtcactagatacttctcccagccactaagttgtgactggggaactttactgttttcacatgcttttctaattgtacctgaaagccccactcccttgttagggagagacattctagcaaaagcaggggccattatacacctgaacataggagaaggaacacccatttgttgtcccctgctggaggaaggaattaatcctgaagtctgggcaacagaaggacaatacggatgagcaaagaatgcccatcttgttcaagttaaactaaaggattctgcctcctttccctaccaaaggcagtacccccttagactggaggcccaccaaggactccaaaagattgttaaggacctaaaagcccaaggcctagtaaaagcatgcagtagcccctgcagtactccaactttacgagtacagaaacccaacagacagtggaggttagtgcaagatctcaggattatcaatgaggccattgtccctctatacccagctgtacctaatccttatattccgctttcccaaatactagaggaagcaaagtggtttacagtcctggaccttaaggatgcctttttctgcactcctatacatgctgactctcaattcttgtttgcctttgaagatccttcgaacccaacatctcaactcacctggactgttttaccccaaggattcagggatagcccccatctatttggccaggcattagcccaagacttgagccagttctcatacctggatattcttgtcctttggtatgcggatgatttacttttagccgcccgttcagaaaccttgtgccatcaagccacccaagtgctcttaaatttcctcgccacctgtggctacaaggtttccaaaccaaaggctcagctctgctcacagcagagggctatttatccctaaatacttagggctaaaattatccaaaggcaccagggccctcagtgaggaatgtatccagcctatactggcttatccttatcccaaaaccctaaaacaactaagaaggttccttggcataataggcataacaggcataacaggtttctgctgaatatggattcccaagtacggcaaaatagccagaccattatatacactaattaaggaaactcagaaagccaatacccatttagtaagatggacacctgaagcagaggcagctttccaggccgtaaagaacaccctaacccaagccccagtgttaagcttgccagcggggcaagacttttctttctatgtcacagaaaaaataggaatagctctaggagtccttacacaggtccgagggaccagcttgcaacccatggcatacctgagtaaggaaattgatgtagtggcaaagggttggcctcattgtttacgggtagtggcggcagtagcagtcttagtatctgaagcagttaaaataatacaaggaagagatcttactgtgtgaacctctcatgatgtgaaccgcatactcactgctaaagaagactggtggctgtcagacaactgtttgcttaaatatcaggctctattacttgaagggccagtgctgtgactgcgcacttgtgcaactcttaacccagcgacatttcttccagacaatgaagaaaagatagaacagaactgtcaacaagtaattgctcaaacctacgccgcttgaggggaccttctagtggttcccttgactgatcccaacctcaacttgtatactgatgaaagttcctttgtagaaaaaggacttcgaaaagcagagtgtgtagtggtcagtgataatggaatacttgaaagtaatcctctgactccaggaactagtgctcagctggcagaactaatagccctcactcaggcactagaattaggagaaggaaaaagggcaaatatatatacagactctaagtatgcttacctagtcctccatgctcacgcagcaatatggagagaaagggaattcctaacttctgagggaacccctatcaaacatcaggaagccattaagaaactattattggctgcacagaaatctaaagaagtggcagtcttacactgctgtaagaaaggacagagaaataaaagggaaccgccgagtggatattgaagccgaaagagccacaaggcgggaccctccattagaaatgcttatagaagaaccgctagtatggggtaatcccctccaagaaaccaagccccagtactcagaagaagaaatagaatgggaaacctcatgaggacgtagtttcctcctcaggatggctagccaccaaagaaggaaaaatacttttgcctgcagctaaccaatggaaattacttaaaacccttcacttaggcattgatagcacccatcagatggccaaatcattatttactggaccaggccttttcaaaactatgaagcagatagtcagagcctgtgaagtgtgccaaaaaataatcccctgcacttcaggccatgcatttcaatccctgaatctttaacctccttgttaagtttgtctcttacagaattgaagctgtaaagctacaaatggttcttcaaatggatccccagatgcagtctatgactcaaatctaccgcggacccttggaccggcctgctagtccatgcttcgatgttgatgatatcaaaggcacccctcccgaggaaatctcaagtgcatgacccttagttgcaccagttcagcaggaagcagttagagcggccgttggccaacctccccaatagtacttgggttttcctgttgagaggggttgctgagagacaggactagctggatttcctaggccgactaagaatccctaagcctagctgggaaggtgactgcatccacctttaaacacggggcttgcaacgtagctcacacccgaccaatgaggtagtaaagagagctcactaaaatgctaattaggcaaaaacaggaagtaaagaaatagccaatcatctatcacctgagagcacagggggagggacaatgatcaggatataaacccaggcgttctagccggcaacggctaccctctttgggtaccctccctttgtatgggagctctgttttcactctattaaatcttgcaactgcac

SEQ ID NO: 36 - DNA, 430 bp, Homo sapiens
gtcaggcctctgagcccaagctaagccatcatatcccctgtgacctgcatgtatacatccagatggcctgaagcaagtgaagaatcacaaaagaagtgaaaatggctagttcctgcctaaactgatgacattccaccattgtgatttgtttctgccccaccttaactgagcgattaaccttgtgaaattccttctcctggctcagaagctcccccactgagcaccttgtgacccccacccttgcccacaagagagcaaccccctttgactgtaattttccactacccacccaaatcctataaaacggccccacccctatctcccttcgctgactgtttttggactcaagccacctgcacccaggtgaaataaacagccctgttactcacacaaatcctgtttggtggtctcttcacacggatgcgcgtga

SEQ ID NO: 37 - DNA, 7777 bp, Homo sapiens
gtcaggcctctgagtccaagctaagccatcatatcccctgtgacccgcatgtatacatccagatggcctgaagcaactaaagatccacaaaagaagtgaaaatagccagttcctgccttaactgatgacattccaccattgtgatttgttcctgccccaccctaactgatcaattgactttctgacaatacaccctccccacccttgtgataactactttgtgatattcccccacccttgtgaatgtactttgtatgatacaccctccccacccttgagaaggtaatttgtaatatcctcccctacccttaacaaggtactttgtaatattctcccccacccttaagaaggtactttgggccgggcgcggtgtctcacgcctgtaatcccagcactttgggaggccgaggtgggtggatcacgaggtcaggagattgagaccatcctggctaacatggtgaaaccccatctctactaaaaatacaaaaaaaattagctgggtgtggtggcgggcacctgtagtcccagctactcgggaggctgaggcagaagaatggcgtcaacctgggaggtggagcttgcagtgagccaagattgcgccactgcactccagcctgggcaacggagcaagactccgtcaaaaaaaaaaaaaagtactttgtaatattctccccatccttgagaatgtacttggtaagatccaccccctgcccacaaaacattgctcctaactccattgcctattccaaacctataagaactaatgataatcccaccaccctttgctgactctctttttgggctcagcccacctgtacccaggtgattaaaaagctttattgctcacacaaagcctgtttggtggtctcttcatacagacacacgtgacatttggtgccaaagacccgggggagggggactccttcgggagaccagtcccctgtcctcaccctcactccatgaggagatccacctaccatcttgggtcctcagaccaaccagcccaaggaacatctcaccaatttcaaatcaggtaagcggtcttttcactctcttctccaacctctcttgctgttgctccacccttcaatctctcccttccttaattttggttcctttccctttctggtagagacagaagagacgtgttttatccataaactcaaaactccagcgctggtcactccagacagtcttccgttggtgtttaatcactgtggggatgcctgcctgattattcacccacatttcagggatgtctgatcactgcggggatgcctgccttgatccttcaccttggtggcaagtaccacctcccctgggtggcaagcaccacctcccctgggtggcaagtaccactccctcctcctccatgtctctaccctctcttttctctgggcttgcctccttcactatgggcaaccttccaccctccattcctccttcttctcccttagcctgtgttcttaagaacttaaaacctcttcaactctcacctgacctaaaacctaagcattttattttcttctgcaacattacttggtgtcaatacaaacttgataatggctctaaatggccagaaaatggcacttttgatttctccattctacaagacctagataatttttgtcaaaaaatgggcaaacggtctgagatgcctgatgtccaggcattcttttacacctcggttcctccctagtctctgctcacaatgcgacccatcccaaatccttctttctctcctgactgttccttcagtctccaccccaagctctgagtcctttgaatcctcctttactacagactcatctgacctctcccctcctccccaggctgctcctcgccaggctgagccaggtcccaattcttcctcggcctccactcccccaccctataatccttctatcacctcccctcctcacacctggtctggcttacagttttgtaccgcaactagccctccgccacctgcccaacaatttcctctcaaagaggtggctggagctaaaggcatagtcaaggttaatgctcctttttctctatcagacctttcccaaatcagttagcatttaggctctttttcaccaaatataaaaacccagcccagttcatggcccatttggcaacaacccttggatgctttactgccctagacccagaggggccagaaggctgtcttattctcaatatgcattttattatccaatccagtcccgatattagaaaaagttccaaaaattagattccggccctcaaaccccacaaaagaacttaattaacctcgccttcaaggtgtacaataataaaaaagaggcagccaagtgccaacatatttctgagttgcaattacttgcctccactgtgagagaaaccccacccacacatttctagcacacaagaactttgaaactcctaaaccacagcagccaggcattcctccaggacctcctcccccaggatcttgcttcaagtgctggaaatctggccactgggccaacgaatgcccacagcctgggattcctcctaagccatgtcccatctgtgcggaccccactggaaatcagactgtccaattcgcctagcagccactcccagagcccctggaactctggcccaaggctctctgactgactccttcccagatcttctcagcttagtggctgaagactgacgctgcccgatcaccttggaaacctcctggaccatcacagctttaggtaactcttacagtggagggtaagtccatccccttcttgatcaatatggaggctacccactccacattaccttcttttcaagggcctgttccccttacctccataactgttgtgggtattgacggccaggctgcgagaccccttaaaactcccccactctggtgccaacttggacaacattcttttatccactcctttttagttatccccacttgcccagttaccttattaggtcaagacattttaactaaattatctgcttccctgactattcctgggctacagccacacctcactgccacccttttccccagttcatagcctccttcgaatcctccccttgtatctccctaccttaatccacaagcatgggatccctctactccctccttggcgactgatcatgcaccccttatcatcccattaaaatctaatcacccttaccatgctcaacgccaatatcccatcccacagcaggctttaaaaaggttaaagcctgttaccaccagcctgttacaacatggcctcttaaagcctacaaactctccttacaactctcctatcctacctgtccaaaaaccagacaagtcttacaggctggtccaagatctttgccttatcaaccaaattgtcttgcctatccaccccatagtgccaaacccatatactctcctatcctcaatacctccctccacaacccattattctgttctggatctgaaacatgctttctttactattcctttacacccttcatcccagcctctcttcactttcacttggactgaccctgacacccatcagtcccagcaacttacctgggctgtactgccacaaggcttcagggacagcccccattacttcagtcaagccctttctcatgatttactttctttctgtccatctgcttctcaccttattcaaaattttgacaaccttctcctttatagcccaccctacaagtcttcccaacagggcaccctcctgctcctccaacatctattctcaaaaggatattgcatatccccctccaaagcccaaatttcttcctcatccgttacctatctcagcacctttcttcataaaaacacacgtgctctccctgctgattgtgtccggctaatctcccaaaccccaaccccttctacaaacaacaactcctttccttcctaggcatggttaaggtactttctcctttggatatctggttttgccatcctgactaaaccattatataaactcacaaaaggaaacttagctgaccccataaatcctaaatcctttccccattcccctttccattccttaaaaaacaaccctaaaagctgctctccctaactcatcccaacccttttcattacacacagctgaagtacagggctgtgcagtcagaattcttacacaagagctgggactgcaccctgtagcctttctgtccaaacaacttgaccttactgttttagactagccctcatctctgtgtgcagcagctgctgctgctctaatacttttagaggccttcaaaatcacaaactatgcttaactcactccctacagttctcataacttccaaaatctattttcttcctcacacctgatgcatatactttctgcccctggctccttcagctatattcactctttgttgagtctgcaacgattaccattgttcctggcccggacttcaatccagcctcccacattattcctgataccccacctgacccccataactgtatctctctgatctaacttgtattcactccatttccccatatttccttctttcctgttcctcaccctgatcacacttggtttattgatggcagttccaccaagcctaatcaccaatcactagcaaaggcaggctatgctatagtatcttccacatctatcattgaggctactgctctgccccactccactacctctcagcaagccaaactcattgccttaactcgagccctcactcttgcaaaaggactacgcatcaatatttatacagactctaaatatgccttccatatcctgcaccatcatgctgttatatgggctgaaagaggtttcctcattacacaagggtcctccatcattaatgcatctttaataaaaactcttctcaaggccgctttacttccaaaggaagctggagtcattcactgcaagggccatcaaaaggcatcagatcccattgcttagggcaacgcttatgctgattaggtagctgaagaagcagctagcattccaacttctgtccctcatggccagtttttctccttctcatcagtcactcccacctactctcccactgtaacttccacctatcaatctcctctcacacaaggcaaatggttcttggaccaaggaacatatctccttccagcctcacaggcccattctattctgtcatcttttcagaacctcttccatgtaggttacaagccactagcctgcctcttagaacctctcatttcctttccatcgtggaaatctatcctcaaggaaatcacttcttagtgttccatctgctattctactactactcagggattgttcaggcccgctcccttccctacacatcaagctcagggatttgcccctgtccaggactggcaaattgatttacttacatgccctgagtcaggcaactaaaatacctcttggtctgggtagacactttcactggatggatagaggcctttcccacaggatctgagaaggctaccgcagtcatttcttccctttttccagacataattccttggtttggccttcctacctctatacagtctcatcacagaccagcttttattagtcaaatcacccaagcagtttctcaggctctattcagtggaagcttcataccccttaccgtcctcaatcttcaggaaaggtagaacggactaatggtcttttaaagacacacctcaccaagctcagcctccaacttaaaaaggactggacagtacttttacctcttgcccttctcagaattagagcctgtcctcgagatgctacagggtacagtccatttgaacttttatatggatgcactttcttgctcggacccaaccttgccccagacaccagccctctaggcgactatcttccagtcttccagcaggctagacaggaaatttgccaggctgctcatcttctcttgcctactccagattcccagccatatgaagacaccctagctggatgataagttcttgttaaaaatctgacccttcaaactctacaacctcgatggactggaccctacttagtcatctctagtaccccaactgctgtccgcctgcaggaccctccccattgggttcaccattccagaataaagctttgtctgtcagacagacagcctgatctctcctcttcctcctggaagtcgcaagtactcaaccctacttcccttaaactcacccgcattcctaaatgataatagtaacccttataagcctaatacatcctatcatttttattaggtctcttcgtccttaccctactcttcccaacaaagctttacgcattcacccctcccacttggattgcaccccaaaaacttgtcatccctactatcttctgtctagtcatattcctattcaccattctcaactactcataagtgtcgtgcccctgtttacactgccagtttacatttttcctccaaaccatcacagcggatatctcctagtactatccccaatccgccactcttgactccctcttggagtggatagatgatctttgctcacagggcacactccaatactttcaccctgatgaagtcctattctttacttttacactcactcttattctcattcccgttcttgtgccaccctctacctctccccagctacctccaccacactatcaatctcactcactctctcctagccgtttctaaaccttctttaacaaacgattgttggctttgcatttctttttcctccaaaatcgccgaggctttgacttactgctaaaaaaaaaggggactctgtatattttttaaaagaagagtgttgcttttacctaaatcaatctggcctggtatatgacaacatcaaaaactcaaggattgagcccaaaaactcaccaaccaagcaaataattacactgaacccccttgggcactctctaattggatgtcctgggtcctcccatttcttagtcttttaatatctgtttttctccttctcttatttggaccttgtgtcttctgtttagtttctcaattcatacaaaactgcatccaggccatcaccattctatatgacaaatgttccttctaataaacccacaatatcaccccttaccccaaaatctttctttaatctttcccactccaggttcccatgctgcccctaatcctgctcaaagcagccatgagaaaaattgcccattatctctccataccacccccaaaaatattttgccgccccaacacttcaccgctattttgttctatttttcttattaatataagaagacagaaatgtcaggtctctcagctgaatctaagccatcatatcccctgtgacctgcacatatacatccagatggcctgaagcaacttaagattcacaaaagaagtgaaaacagccagttcctgccttaactgatgacattccaccgttgtgatttgttcctgccccaccctaactgatcaattgactttgtgacaatacaccctccccgccctcgcaataatgtactttgtgatattcccttgcctttgtgaatgtactttgtactatacaccctccccaccattaagaaggtactttgtaatattctcccccacacttaagaaggtactttgtaatattctccacatccttgagaatatactttgtaagatccacccgctgcccgcaacaaaattgctcctaactccaccgcctatcccaaacgtataagaactaatgacaatcccaccaccctttgctgactctcttttcggactcaggctgcctgcacccaggtgattaaaaagctttattgcttacacaaagcctgtttggtgatctcttcacacagacgcgcgcatgaaa

SEQ ID NO: 38 - DNA, 4218 bp, Homo sapiens
gtcaggcctctgagcccaagctaagccatcatatcccctgtgacctgcacatacacatccagagggccggttcctgccttaactgatgacattatcttgtgaaattgcttctcctggctcatcctggctcaaaagctccccttctgagcatcttgtgaccccctagtcctgcccacagagaacaaaccccctttttcctttacctacccaaatcctataaaatggccccacccccatctcccttcactgactctgttttcggactcagcccacctgcacccaggtgaaataaacagctttattgctcacacaaagcctgtttggtggtctctttacatggacgcaagtgaaatttggtgccgtgactcggatcgggggaccccccttgggagatcaatccactgtcctcctgctctttgctccgtgagaaagattcacctacgacctcaggtcctcagaacgaccagcccaagaaacatctcaccaatttcaaatctggtaagtggcctctttttactctcttctccaacctccctcactatccctcaacctctttctcctttcaatcttggtgccacacttcaatctctcccttctcttaatttcaattgctttcattttctggtagagacaaaggagacacattttatccgtggacccaaaactccggcgccagtcacggactagggaaggcagccttcccttggtgtttaatcattgcagggatgcctctctgattattcacccaggtttcagaggtgtcagaccatgcagggatgcctgccttggtccttcacccttagtggcaagtcccgcttttctgggggaggggcaagaaccccaaccccttctctccatgtctctaccccttttctgcttttctgggggaggggcaagaacccctcaaccctgtctccttcacccttagtggcaagtcccgcttttctgggggaggggcaagaacccctcaactccttctccttcacccttagcagcaagtcctgtttttctgggggaggggcaggagccccgacctcttatctctgtgccccgatcccttatttccgtgccccgacctcttatctctgtgacccgaccccttatttctgtgccctgaccccttctctgcttttctggagggcaagaacccctcaccccttctccatgtctctactctcttttctctgggcttgcctccttcactataggcaagcttctaccttccattcctccttcttctcccttagcctgtgttcttaagaacttaaaacctcttcaactctcacctgacctaaaatctaagtgtcttattttcttctgagatgctgcttgaccccagtacaaactcgacagtagttccaaatagctggaaaacggcactttaatttttccatcctacaagatctaaataattcttgttgtaaaataggcaaatggtctgagatgcctgacgtccaggcattcttttacacatcagtccttccctagtctctgttcccaatgcaactcatcccaaatcttccttctttctctccctcctgtcccctcagcccaaaccccaagcattgctgagtctttttaatcttccttttctacagacccatctgacctctcacctccccgccaggccgagctaggtcccaattcttcctcaacctctgctcctccaccctataatccttttatcacctcccctcctcacacctggtcaggcttacagttttgttccatggctagccctcccccacctgcctagcaatttactcttaaaatggtggctggaactaaaggcatagtcaaggttaatgctccttttcctttattcccaaatcagatagtgtttaggctctttttcatcaaatataaaaatccagcccagttcatggctcgtttggcagcaaccctgagacacttttcagccctagaccccaaaaggtcaaaaggccgtcttattctcaatatacattttattacccaatctgctcccaacattaaataaaactccaaaaattaaattgtggctctcaaaccccacaacaggacttaattaaccttgccttcaaggtgtacaataatagagtagaggcagccaagtagcaacatatttctgagttgcaattccttgcctccactgtgagacaaaccccagccacacctccagcacacaagaacttccaaacacgcctaaactgcagtggccaggcgttcctccagaaccacttcccccaggagcttgctacaagtgccagaaatctggccaccaggccaaggaatgcccagcagtcctcctaagctgtgtcccaactgtgtgggaccccactggaaattggattgttcaactcacctggcagccactcccagagcccctggaactctggcccaaggctctctgactccttcccagatcttctcggcttagcggctgaagactgatgctgcccaattgcctcggaagccctgtagaccatcacagacaccgagctttaggtagctctcacagtggagggtaagtccttccccttcttaataaatacagagtctacccactccatattaccttcttttcaagggcctgtttcccttgcctccataactgttgtaggtattgacagccaggcttctaaacctcttaaaactccccaactctggtgccaacttagacaatactcttttaagcactcctttttagttatccccacctgcccagttcccttattaggccgagacactttaactaaattatctgcttccctgactattcctggattacagctacatctcattgccgcccttcttcccaatccaaagcctccttttcgtcctcctcttgtatcccccccaccttaacccacaagtataagataccgctactccctccttggcgaccgatcatgcaccccttaccatctgattaaaacctaatcacccttaccccactcaatgccaatatcccatcccacagcatgctttgaaaggattaaagcctgttatcacttgcctgctacagcatggccttttaaagcctataaactctccttacaattcacccattttacctgtcttaaaaccagacaagccttaaaagttagttcaggatctatgccttatcaaccgaattgttttgcctatccaccccatgatgccaaacacatatactctcctatcctcaatacctccctccacaatccattattcggttctggatctcaaacatgctttctttactattcctttgcacccttcatctcagcctctcttcgcttttacttggactgacccagacacccatcaggctcagcaaattacctgggctgtactgctgcaaagcttcacggacagcctccattacttcagtcaagcccaaatttcttccttatctgttacctatctatctcagcataattctcataaaatacacgtgctcttcctgctgatcgtgtctgactaatctctcaaaccccagcaccttctacaaaacaacaactcctttccttcctgggcatggttggacactttcacctttggatacctggttttgccatcctaacaaaaccattatataaactcacaaaaggaaacctagctgaccccatagatcctaaatcctttccccactcctctttccattccttgaagacagctttagagactgccccgaccctggctctccctgactcatcccaacccttttcattacacacagccgaagtgcagggctgtgaagtcggaattcttacacaaggaccgggattgtgtcctgcaggctttttgtccaaacaacttgaccttactgttttaggctggccatcatgtctccgtgcagcagctgctactgccctaatacttttagaggcccttaaaataaaaaactatgcacaactgactctctacagctctcataatttccaaaatctgttttcttcctcacacctgacgcatatactttctgctccctggctccttcagctgtactcactctttgttgagtctcccacaattaccattgttcctggcccggacgtcaatccggcctcccacattattcctgataccacacctgaccctcatgactgcatctctctgatccacctgacattcaccccatttccccacatttccttcttccctgtttctcaccctgatcacacttggtttattgatgacagttccaccaggcctaatcgccacacaccagcaaaggcaggctatgctatagca

SEQ ID NO: 39 - DNA, 972 bp, Homo sapiens
gtggggaaaagaaagagagatcagattgttactgtgtctgtgtaggaagaagtagacataagagactccattttgttctgtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtacccagagacacactacactgcggaagactgcagggacctctgcctaggaaagccaggtattgtccaaggtttctccccatgtcatagtctgaaatacagcctcatgggaagggaaagacctgactgtcccccagcccgacacccgtaaagggtctgtgctgaggaggattagtaaaagaggaaggaaggcctctttgcagttgagataagaggaaggcatctgtctcctgctcatccctgggcaatggaatgtctcggtgtaaagcccgattgtatattccatctactgagataggagaaaaccgccttaggactggaggtgggacatgctggcagcaatactgctctttaaggcattgagatgtttatgtatatgcacatcaaaagcacagcacttttttctttaccttgtttatgatgcagagacatttgttcacgtgtttacctgctgatcttctctccactattatcctattgtcctgccacatccccctctccggaaacgcccaataatgatcaataaatactaagggaactcagaggccagtgcaggcatgggtcctccgtatgctgaacgccagtcccctgggcccatttttctttctctgtactttgtctctgtgtctctttcttttccaagtctctccttccacctaacgagaaacgcccacaggtgtggaggggcaacccatcccttca

SEQ ID NO: 40 - DNA, 957 bp, Homo sapiens
gtggggaaaagaaagagagatcagactgttactgtgtctatgtagaaagaagtagacataagagactccattttgttctgtagtaagaaaaattcttctgccttgagatgctgttaatctgtatccctatccccaaccctgtgcttgcagaaacatatgctgtgtcaactcaaggtttaacaaagcaggatgtgctttgttaaacaaatgcttgaaggcagcatgcttgttaaaagtcatcaccactccctaatctcaagtacccagggacacaaaacactgcggaagtccacagggacctctgcctaggaaagccggatattgtccaaggtttctccccatgtgatagtctgaaatatggcctcgtgggaagggaaagacctgactgtcccccagcctgacacccgtaaagggtctgtgctgaggaggattagtaaaagaggaaggcctttttgcagttgagataagaggaaggcatctgtctcctgctcgtccctgggcaatggaatgtctcggtttaaaacccgattgtatattctatctactgagataggagaaaactgccttagggctggaaatgagacatgctggtggcaatactgctctttaatgcattgagatgtttatgtatgtgcacaaaaaagcacagcgcctttttctttacctcatttatgatgcagagacatttgttcacatgttttcctgctgactctctccccactattaccctattgtcctgccacatctccctctccgagagggtagagataatgatcaataaatactgagggaactcagagactggggccggcgtgagtcctcagtatgctgagcgccggtcccctgggcccacttttctttctctatactttgtctctgtgtctctttcttttctcagtttctcatcccacccgacaagaaacacccacaggtgtggaggggcaggccaccccttca

SEQ ID NO: 41 - DNA, 972 bp, Homo sapiens; identical to SEQ ID NO: 39

SEQ ID NO: 42 - DNA, 5642 bp, Homo sapiens
gtcaggcctctgagcccaagctaagccatcatatcccctgtgacctgcacgtatacatccagatggcctgaagtaactgaagatccacaaaagaagtgaaaatagccttaactgatgacattccaccattgtgatttgtttctgccccaccctaactgatcaatgtactttgtaatctcctccacccttaagaagattctttgtaattctccccacccttgagaatgtactttgtgagatccaccccctgcccccaaaacattgctcctaactctaccgcctatcccaaaacctgtaagaactaatgataatcccaccaccctttgctgactctctttttggactcagcccgcctgcacccaggtgaaataaacagccttgttgctcacacaaagcctgtttggtggtctcttcacacagacgtgttagacatttggtgccgaagacccgggtcagagggactccttcgggagtcccttgtcctcaccctcacttcgtgaagagatccacctacaatctccggtcctcagaccaaccagtccaaggaacatcgcaccaatttcaaattgggtaagcggtcttttcactctcttctccagcctctctcgctacccttcaatcttcctctcttgctaccctttgatctccctgtccttccaattccagttctttttcctctctagtagagacaaaggagacacattttatccatggacccaaaactccggcgctgatcacggactcaggaagacagccttcccttggtgtttaatcattgcggggatgcctgcctgattattcactcactctccattggtgtctgatcaccgcggggacgcctgccttggtcattcacccacattcccttggtggcaagtcaattgcggggatgcctgctttggctgctcacccacattgcagcccagggctgctccccaccccccttctctgtgtctctacccttctctttaaacttcctccttcactataggcaaacttccaccctccattcctcctttttctcccttagcctgtgttctcaagaacttaaaacctcttcaactcttgcctgacctaaaatttaaacaccttattttcttctgcaataccacttggccccagtacaaactctacagtagttccaagtggccagggaatggcacttttgatttgtctatcctacaagatctacagaatttttgtcgaaaaatgggcaaatggtctgaggtgcctgatgtccaggcattctttacacattggtccctccctagtctctgctcccgatgagactcatcccaaatctttcttctttctctgctgtctgttccttcagtctccaccccaagctctgagtcctttgaatccttattttctatggactcatctgacctctccccttctccctgggctgctcctcgccaggccgagccaggtcccaattcttcctcagcctctgctcccccaccctataatctttctatcacctcctctcctcacacctggtctggtttacagtttcgttctgtgactagctctctccgacctgcccaacaatttcctcttagagaggtggctggagctgaaggcatagtcagggtacatgtgcctttttctccatgagacctttcccaaatcagccggcgtttaggctctttctcatcagaccccactaaatatatacaggaattccgatatccaattctgtcctacaatttaacctggagtgacttaagtgtcaacctaacttctacccgctccccagatgaatgggaaagagttttttctccagcccaatctcatgctgataaccgccagcttcataagccaggcctccaggaaggcattagagcagttcccctagaagatccccagtggaactatcaggcagattccccaggtatagctgggcaagattacatggtttcctgcctagttgaagggcttaaaaaggcagcttacaaacctgttaattctgacaaacttaaagaaactacccaaggtaaagacgaaaacccagcccagttcagggcccgcttagcagcaacacttagacgctttaccgccctagacccagaggggccagaaggccgccttattcttaatatgcattttatcacccagtcagctcctgacgttagaaaaaagcttcaaaaattggaatctggccctcaaaccccacaacaggaattaatcaacctcgccttcaaggtgtacaataatagagaggatagagaggaggtagccagacagcaacgcatttctgagttacagctacttgcctctgctgtaagacaacccacaaccacgtctccagcatacaagaacttcagaacatcaaagccacagctcccaggggctccttcaaaacatcctcgtggaccttgcttcaaatgccaaaagcctggccactgggcctcagtatgcccgcagcctgggattcctcctaagccgtgccctgcctgtgctggcccccactggaggtcggactgcccgactcacatcgctgccgctcctaaagcccctggaacccagacccaacgttctttggccgactcattcccagatctcctcggcttagcagctgaagactgatgccgcctgatcgcctcggaagccccctggaccatcacagacaccgagctttgggtaactcttacagtggagggtaagtccgtcccctctttaattgatatgggggctacccactacacattaccttcttttcaagggcctgtttcccttgcccccataactgttgtgggtattaatggccaagccccaaaaccccttaaaactctccaactctggtgccaacttggacaacattcttttatgcactccttttaattatccccaactgcccagctcccttattaggtcgagacattttaactaaattatctgcttccctgactattcctgggctacagccacacctcattgctgcctttcccccagttcaaagcctccttcacatcctctccttgtatctccccaccttaatccacaagtataggacacctctactccctccttggcgatggatgatggaccccttatcatcccattaaaacttaatcactcttaccccgctcaatgccaatatcccatcccacagcatgcttaggaggattaaagcctgttatcactcacctgctacagcatggccttttaaagcgtataaactctccttacaattcctccattttacctgtccagaaactggacaagtcttacaggttagttcaggatctgcgccttatcaaccaaattgtcttgcctattcaccccatggtgccaaagccatatactctcctatcctcaatacctccctccacagcccattattctgttctagataaacctagctgaccccataaatcctaaatcctttccccactcccctttccattccttaaaaaatagccctaaaggctgctcccacactagctctccctaactcatcccaacctttttcattacacacagccgaagtgcagggctgcatggtcggaattcttacacaagagccgggacggtgccctgtagtctttctgtccaaacaacttgaccttactcttttagcctagccctcatgtctgcgtgtggcggctgccactgctttaataggggccctcaaaatcacaaactatgctcaactatctacaattctcataacttccaaaatctattttcttcctcatacctgacacatataccttctgctccctagatcctttggctagactcactcttttttgagtctcccacaattaccattgttcccggcctggacttcaatccagcctgtcacattattcctgataccacacctgacccccatgactgtatctctcggatacacctggcattcgctccatttccccaaattttcttctttcctgttcctcaccctgatcacacctggtttagtgatggcagttccaccaggcctaatcaccacacaccagcaaaggcaggctattctatagtatcttccacatatatcattgaggctaccactctgcccccctccactacctctcaacaagccaaactcattgccttaactcgagccctcactattgcaaaggactacgcatcaatatttatactgactctaaatatgccttccatatgctgtaccaccatgctgttacatgggcaaaaagaggtttcctcactacacaaaggtcctccatcaataatgcctctttaataaaaactcttctcaaggccgctttacttccaaaaaaacctagagtcattcactgcaagggtcataaaaaggcatcagatcccatcactcagggcagcacttatgctgataaggtagctaaaaaagcagctagcattccaacttctatctctcacggcagtttttctccttctcatcggtcactcccacctactcccccactgaaatttccacctatcaatctcttcccacacaaggcaaatggttcttagaccaaggaaaatacctccttccagcctcacaggcccattctattctgtcatcatttcataacctcttccatgtaaaagttacaagccactagcctgcctcttagaacctctcacttcctttccatcgtggaaatctatccttaaggaaataacttctcagtgttccatctgctattctactactcctcagggattattcaggccccctcccttctctacacatcaagctcggggatttgcccccacccaggactggcaaattgactttactcacatgctccaagtcaggaaactaaaatacctcttggtctgggtagacactttcactggatgggtagaggcctttcccacagggtctgagaaggccactgtggtcattgcttcccttttgtcagacgtaattcctcagtttggccttcccacctctatacagtctgataatggactggcctttattagtcaaatcacccaagcagtttctcaggctcttggtattcagtggaatcttcataccccttatcgtccttaatcttcaggaaaggtagaatggactaatggtcttttaaaaacacacctcaccaagctcagcctccaacttaaaaaaggaggactctgtcaaggatagatcccaaaaactcaccagccaaacaagtaattacactgaaccccgttgggcactctgtaattggatgtcctgggtcctcccaattcttagtcctttaatatctgtttttctccttctcttatttggacctcgtgttttccgtttagtttctcacttcatccaaaaccgtatccaggccatcaccaatcctatacgacgaatgtttcttctaacaaccccacaatatcaccccttaccacaaaatcttccttcagcttaatctcttccactctaggttcccacgctgcccctaatcccactcgaagcagccctgagaaacattgcccattatctctccataccacccccaaaaattttcactgccccaacactttaccactatttcattttatttttcttatgaatataagacaggaatgtcaggcctctgagcccaagctaagccatcatatcccctgtgacctgcatgtatacatccctctggcctgaagtaattgaagatccacaaaagaagtgaaaatagccttaactgatgacattccaccat

SEQ ID NO: 43 - DNA, 482 bp, Homo sapiens
gtaggagttcggtcagggtagtgggagaaattataagaagaaattataggaaaagatgcaaaccttcttggaaggctgggaggttttgcaaaagctttgaaagataatttggctgaaggcagccaaattctcttatccagagcctgagagcaaaaggtagataacaaggaagtgtaaaggaattgatctaggtaagttaagtttacttaggcctcagaacctggcctttaatcatgtgcgtgcaggactgctctctccaggtaaatacccacaagttgtgttgactgaaagcctttgtcattaaatgtgtattaaataaatgcccacttctcagggctgcaactgctgtgactctttacagcaccttcctgggtgtctgtgagcggtcagtcccctagccgtgtgcccaggcaaaaaaaacctgtgtctgcgtacattttctcatccgtcgcttggccagagtctgcgggtcagacccagca

SEQ ID NO: 44 - DNA, 6042 bp, Homo sapiens
gccaggcctctgagcccaagctaagccatcatatcccctgtgacctgcatgtacacatccagatggccggttcctgccttaactgatgacattccaccacaaaagaaatgaaagtggcctgttcctgccttaactgatgacattatcttgtgaaattccttctcctggctcatcctggctcaaaagctcccctactgagcaccttgtgaccgccccccctgcccgccagagaacaacccccctttgactgtaattttcctttacctacccaaatcttataaaacggccccacccctatctcccttggctgactctcttttcggactcagcccgcctgcacctaggtgaaataaacagccttgttgctcacacaaagcctgtttggtggtctcttcacacagacgcgcatgaaatttggtgctgtgactcagattggaggacctcccttgggagatcaatcccctgtcctcctgctctttgctctgtgaaaaagatccacctacgacctcgggtcctcagacccaccagcccaaggaacatctcgccaattttaaatcgggtaagcggcctcttcttactctcttctccaacctctctcactatccctcaaccactttctcctttcaatcttggcgccacccttcaatctctccctctcttactttcaattcctttcattttctggtagagacaaaggagacacattttatccttggacccaaaactctggcgccagtcacggactaaggaaggcagccttcccttggtgtttaatcattgcagggacacctctctgatttttcacccatgtttcagaggtgtctgaccacatggggacacctgccttggtccttcacccttagcagcaagtactgcttttctagggggcaagaaccccccaaccccttctctccatgtctctactcctctgcttttctagagggcaagaacccccccaaccccttctccttcacccttagctgcaagtaccacttttctagggggcaagaaccccccaaccccttctctccgtgtctctaccccttctctgcttttctgggggcaagaacccccgatcccttatttctgtgccccaacctcttatctctgtgccccatcccttatttccacgccctgaccccttatctctgagccccgatcccttatttccatgccccgacctcttatctctgcgccccgatcccttatttccgcaccccaacctcttatctctgtgccccgatcccttatttccacaccgcaatcccttatttccgcaccctgacctcttatctctgcaccccaaccccttatttctgtgccccgacccctttcctgcttttctggagggtaagaacccccgaaccccttccctccgtgtctctactctcttttctctgggcttgcttccttcactatgggcaaccttccaccctccattcctcctccttctcccttagcctgtgttcttaagaacttaaaacctcttcaactctcacctgacctaaaatctaagcatcttattttcttctgcaatgctgcttgaccccaatacaaactcaacagtagttccaaatagccagaaaatggcacttttaatttttccatcctacaagatctaaataattcttgtcataaattaggcaaatggtctgaggtgcctgacgtccaggcattcttttacacatcggttcctccctggtctctgttcccaatgcaaccagtcccaaatcttccttctttccctcccacctgtcccctcagtcccaaccccaagcatcactgagtctttctaatcttccttttctacagacccatctgacctctcccctcctcaccaggcagagccaggtcccaattcttcctcagcctctgctcccccaccctataatccttttatcacctcccctcctcacaccttgtccggcttacagtttcattcctcaaccagccttcccccacctgcccagcaatttcctcttaaaaagatggctggatataaaggcatagtcaaggttaacgctcctttttctttatccgacctctcccaaaatcagttagcgtttaggctctttttcatcaaatatgagaaacccagcccagttcatggctcgtttggcagcaaccctgagacgctttacagccctagaccctgaaaggtcagaaggccatcttattctcaatatgcattttattttattacccaatctgctcccgacattaaataaaactccaaaaattaaattccagccctcaaaccccacaacaggacctaattaacctggccttcaaggtgtacaataatagagtagaggcagccaagtagcaatatatttctgagttgcaattccttgcctccactgtgagacaaaccccagccacatctccagcacaaaagaacttccaaacgcctaagtcgcagtggccaggcgttcccccaggcccgcctcccccaggagcttgctacaagtgccagaaatctggccaccaggccaaggaatgcccgcagcccacgattcctcctaagccgcgtcccatctgtgcaggaccccactgaaaatcagactgttcaactcacctggcaaccagtcccacagcccctagaactctggcccaaggctctctgactgactccttcccagatcttctcggcttagcagctgaagactgaaactgcccgattacctcagaagcttacaggaccatcacagatgctctaggtaactcttacagtggaaggtaagccgtccccttcttaatcaatatggaggctacccactccacattaccttcttttcaagggcctgtttcccttgcctccataactgttgtaggtattggcggccaggcttctaaacctcttaaaactccccaactctggtgccaacttagacaatactcttttaagcactcctttttagttatccccacctgcccagttcccctattaggctgagacactttaactaaattatctgcttccctgactgttcctaggctacagccacacctcattgccaccttttcccccagttcaaagcctccttcacatcctccccttgtatctccccaccttaacccacaagtataagacacctctactccctccttagcaaccaatcatccaccccttaccatctcattaaaacctaatcactcttaccccgctcaatgccaatatcccatcccacagcacactttaaaaggattaaagcctgttatcactcacctgttacagcaaggccttttaaagcctataaactctccttacaattcccccattttacctgtccaaaaaccagacaagccttacaggttaattcaggatctgcaccttaccaaccaaattgttttgcctatctaccctgtggtgccaaacccatatactctcctatcctcaatacctccctccacaacccattattctgttctagatctcaaacatgctttctttactattcctttgcacccttcatcccagcctctcttcgctttcacttggactgaccctgacacccatcaggctcagcaaattacctgggctgtactgccacaaagcttcacagacagcccccattacttcagtcaagcgcaaatttcttcctcatctgttacctatctcggcgtaattctcataaaaacacatgtgctctccctgctgatcatgtccagctgatctctcaaaccccaacaccttctacaaaacaacaactcctttccttcctaggcatagttagatacttttgactttagatacctggttttgccatcctaacaaaaccattatataaactcacaaaaagaaacctagctgacccatagattctaaatcctttccccactcctctttccattccttgaagacagctttagagactgcccccaccctagctctccctgactcatctcaacccttttcattacccacagctgaagtgcagggctgtgcagtcagaattcttacataaggaccaggatcacgtcctgtagcctttttgtccaaacaacttcaccttcctgttttaggctggccatcctgtctccgtgcagtggctgctgccgccctaatactttagaggcccttaatataacaaactatgctcaactcactctctacagttctcataacttccaaaatctattttcttcttcacacctgacacatatattttctgctccccggctccttcagctgtactcactctttgttaagtctcccacaattaccactgttcctggcccagacttcaatccggcctcccacattattcctgataccacacctgtcccctatgactgtatctctctgatccacctgacattcaccccatttccccatatttccttctttcctgttcctcaccctgatcacacttggtttattgatggcagttccaccaggcctaatggccacacaccagcaaaggcaggctatgctatagtacaagccactagcccacttcttagaacctctcatttcctttccatcatggcaatctatcctcaaggaaataacttctcagtgttctatctgctattctactactcctcaaggattattcaggccccctcccttccctacacatcaagctcggagatttgcccctacccaggactggcaaattggctttactcaacatgccccgagtcagaaaacaaaaatacctcttagtctaagtagacactttcactggataagtaaaggcctttcctacaaggtctgagaaggccactgctgtcatttcttcccttctgtcagacataattcctcggtttggccttcccacctctatacagtccaatagcagactggcctttattagtcaaatcagccaagcattttttcaggctcttagtattcagtgaaacctttatatcccttacagtcctcagtcttcaggaaaggtagaacggactaatggtcttttaaaacctcaccaaactcagccaccaacttaaaaaggactggacaatacttttaccactctccgttctcagaattcaggcctgtcctcagaatactacagggtacagcccatttgagctcttgtatagatgctcctttttattaagccccagtctcattccagacacaagaccaacttggactgtgccccaaaaaacttgtcatccctactatcttctgtctagtcatactcctattcactgttctcaactactcatacatgccctgctcttgtttacactgccagtttacactgtttctccaagccatcacagctgatattggtgctatccccaaactgccactcttaactcttaaagtaaatgaataatctttgctggcaggactatgctgaatctccttaggcactctctaattagatgtcctaagtcctcccaattcttagacctttaatacctgtttttctccttctcttattccgtttagtttttcaattcatacaaaaccatatccaggccatcaccaataattctaaatgtttcttctaacaatcccacgatatcaccccttaccacaaaatcttcagcttaatctctcccagtctaggttcccatgccgcccctaatcccgctcgaagcagccctgagaaacatcgcccattatctctccataccacccccaaaaatttttgccatcccaacactttaccactatttcgttttatttttcttattgatataagaagacaggaatgtcaggcctctgagcccaagctaagccatcatatcccctgtgacctgcatgtacacatccagatggccagttcctgccttaactgatgacattatcttgtgaaattccttctcctggctcttcctggctcaaaagctcccctactgaccaccttgtgacccccactcctgcccaccagagaacaacccccctttgactgtaattttcctttacctacccaaatcttataaaacggccccatccctatctcccttggctgactctcttttcggactcagcctgcctgcacccaggtgaaataaacaaccttgttgctcacacaaagcctgtttggtggtctcttcacatggacgcgcatgaaa

SEQ ID NO: 45 - DNA, 963 bp, Homo sapiens
gtgtgggaaagaaagagagatcagactgttactgtgtctgtgtagaaagaagtagacgtaagagactccattttgttctgtactaagaaaaattcttctgccttgagatgctgttaatctgtaaccctacccccaaccctgtgctccctgaaacatgtgctgtgtcaactcagggttaaatggattaagggctgtgcaggatgtggtttgttaaacaaatgcttgaaggcagcatacttgttaagagtatcaccactccctaatctcaagtacccagagcacaatacactggagaaggccgcagggacctctgcctaggaaagccaggtactgtccaaggtttctcccatgtgatagtctgaaatatggcctcgtgggaagggaaagacctgaccatcctccagcccgacccccataaagggtccctgctgaggaggattagtaaaagaggaaggaaggcctctttgcagttgagataagaggaaggcatctgtctcctgctcctccctgggcaatggaatgtctccctgtaaagcccgattgtatattccatctactgagataggggaaaactgccttaggggtggaggtgggaaatgctggcagcaatactgctgtttaaggcattgagatgtttatgtatatgcacatcaaaagcacagcactttttatcttgtttatgatgcagagacatttgttcacatgttttcctgctgaccttctctccactattaccctattgtcctgccacatcccctctccgagaaacacccgataatgatcaataaatactaagggaactcagaggccagtgccggcgcgggacctccgtatgcgaacgccggtcccctgggcccatttttctttctctatactttgtctctgtgtctctttcttttccaagtctctcgttccacctgatgagaaacgcccacaggtgtggaggggcaacccaccccttca

SEQ ID NO: 46 - DNA, 9509 bp, Homo sapiens
tgcacggaaaagaaagagagatcagacggttactgtgtctatgtagaaaaggaagacataagaaacttcattttgatctgtaccctgactttgccctgagatgctgttaatctgtaactttagccccaactttgagctcacagcagcatgtgttgtatagaatcaaggtttaagggatccagggctgtgcaggatgtgctttgctagcaaaatgtttacaggcactatgcttgataaaagtcatcaccattctccattctcaagtaaccaggggtgcaatacactgtgaaaaacctcagggacccctgccctggaaagccaggtattgtccaaggtttctccccatgtgatagtctgaaatatgacctcattgaatgggaaagacctgaccttccacccagcttgacatccattaagggtctgtgctgaggaggattagtaaaagaggaaggcctcttgcagttgagataagaggaaggcttctgtctcctgcctgcccctgggaactgaatgcctcagtataaaacctgattatacatttgttctattctgagataggagaaaaactgcctgtggtgggaggcgagacatgttggcagcaatgctgctttgttactctttactccactgagatgtttgagtggagaaaagcataaatctggcctatgtgcacatccgggcatagtatcatcccttgaacttatttgtgacacagattcctctgctcacatgttttcttgctgactttctccccactatcaccctgctctcctgccacttttcccttactgagttagtgaaaatagtaatcaataaatactgagggaactcagagaccagtgccggtgtgcgtcctccatatgctgagcaccagtcccctgggcccatttttctttctctatactttgtctctgtgtcttatttcttttctcagtctcttgtcctgcctgatgagaaatacccacaggtgtggagtggctgacccctttcatctggcgcccaacgtgggcctttctctagggtgaaggtatgctaaaaacgtgagcattgaagacagtcaacgagagattcccaagtacttccacggtcagccatgcggtaagcttgtgtgctcagaggaacccagggtaacaatgggacaaactgaaagtaaatatgcctcttatctcagcttcattaaaattcttctaagaagatggggagttagagcttctacagaaaatctaattatgttatttcaaacaatagaacaattctgcccatggtttccaaaacaaggactttagatctaaaagattgggggaaaattggcaaagaattaaaacaagcaagtagggaagataaaatcatcccacttacagtatggaatgattggcccattattaaaacaactttagaaccgtttcaaatagaaacagatagcctttcaatttctgatgcccctgaaagctgtgtagtagattgtgaagaagaggcagagacaaaatcccggaaattaatggaaagttcacattgtaaaatgtaacagagtctgtaatggctcagtcaacgcaaaatgttgactacaatcagttacaggaggtaatatatcctgaatcatcaaaactggtggaaggaggtccagaattattggggctaccagagcctaaaccacaatggccatcaactcctcctccagcggttcagatgcctgtaacattacaacctcaaatgcaggttagacaagtgcaaaccccaagagaatatcatgtagaaaaggatagagtctctatcccggccatgccaattcagatacagtatccacaatatcagctggtagaaaataagacccaaccaccggtagtttatcaatactggccgccagctgagcttcagtatgggccgtctccggaggttcaatacagacctcaagctgtgtgtcccgtgccacacagcacggcacctcaccagcaacccagcggtgtttagtcctacatcaccacctagtggacaaggtagtacactgcatgaaattattgataaagccagaaaacagggagatcttgaggcatggcagttccttgtaattttacaaccaataccagctgggaaaggggggcaagctggagcgtctgtccaaactgaggctagatatgaatctttcaccatgaaaatgttaaaagatatgaaggaaggagttaaacaatatggacccaactccccttatatgagaactttattagatcccattgctcatggaaatagacttattccctatgattgggaaatgttggctaaatcttccctttcaccctctcagttcctacaatttaaaacctggtggattgatggagtacaagaacaggcacgaaaaaatcaggctatttatcccgctgttaatatagatgcagatcgattgctaggaacaggtccaaattggagcacaattggccaacagtcagtaatgcagaatgagggtattgaacatctaagggctctttgcctcagggactgggaaaaaattcaggacccaggcacctgggtgccccacgcaccacttgcccaggcaccgcttgcccttcttctaattcaattagacaaggctgcaaagagccatatccagactttgtggcaaggttgcaagatgcctctgaaaaatctgtttcggatgataatgcccaaaaagttattgtagaaataatggcttatcaaaagtcaaatccagaatttcaaccagccataaagccattaaaaggaaaaggtccagcaggagttgatgtaattacagaatatgtgaaagcttgtgatgggattggaggagctatgcgaaaggcaatgctaatggctcaagcaatgaccggagtcactttaggaggatagttagagcatttggggggaaatgttataattgtggtcaaatcggtcatctaaaaaagaactgcccagtcttaaataaacagagtaaaaataaagagccacctggcctgtgtccaagacatggaaaaggaaaacattgggctaatcaatgtcgtcctaaatatgataaaaatgggcaactattgtcggaaaaaggggtgaggggccagcctcagtcccaacaacaaactggggcattcccgattcagccgtttgttcttcagggttttcagggacagcaaccaccacagcaaataccaccacttcagggaatcagccaattacaacgatacaacagctgtcccccgccacagcaggcagcacagcagtagatttatgttccactcaaaaggtttctttactccctggagagaccccgcaaaagattcctacaggggtatatggcccactgccaggagggacagtaggcctcattttagggagatgaagtctaaatttgaagggagtccaaattcatactggggtaattgattcagattataaaggggaaattcagttagtgatcagctccactgttccctggagtgccaatccaggtaatagaattgctcaattattgcttttgccttatattaaaattggggaaaataaaacggaaaggacaggagggcttggaagtaccaactctgccggaaaagccactcattgggctcgtcaggtctcagagaatagatctgtgtgtacagtcactattcagggaaagcagtttataggattagtggataccgatgctgatgtttccattatcgccttaaatcaatggccaaaaaattggcctaaacaaaagcctgttacaggacttgtcggtgtgggcagcgcctcaaaagtgtatcaaagcaccatgattttacattgtctaggacctgataatcaagaaagtacagttcaacctatgattactgctattccaattaatttatggggccgagacttgttacaacaatggcatgcagagatgactatcccagcctccttatacagccccacgagtcaaaaaatcatgactaaaatggggtatctccctggcaaaggactagggaaaaatggagatggcattaaaatcccaattgaggctgagggaaatcaagaaagaaaaggaataggatatccttttcaggagtggccactgtagagcctccaaaacccattccattaacttggaaaacagaaaaacctgtatgggtaaatcagtggctgctaccaaaacaaaagctggaggctttacacttatgggcaaaagaacaattagcaaagggacatattgagccttcactttcgccttgaattctcctgtgtttgtaactcagaaaaaatccagcagatggcgcatgttaaccgacttaagagccgtcaacgctgtaattcaacctatgggggctctccaacctgggttgccctctctggccatgatccccaaagattggcctttaattataattgatctgaagggttgcttttttaccattcctctagcaaaacaggattttgaaaaatttgcttttactataccagccataaataataaagaaccagccaccaggtttcagtggaaagtgttgcctcagggaatgcttaatagtccaactatttgtcagatttttgtagctgaagctcttcaaccagttagagacaagttttcagactatgtctttcattatgttgatgatcttttgtgtgctgcagaaacgagagacacattaattgactgttacacatttctgcagacagaggttgcaaacgcaggactgacaatagcatctgataagattcaaacctctactcctgtccattacttgggaatgcgggtagaggaaagaaaatttaaacaacaaaaaatagaaataagaaaagacacattaaaaacattaaacgactttcataaattgctaggagatattaattggatttggccaactctaggcatccttacttatgccatgtcaaatttgttctctatcttgagtggggatccagaattgaatagtaaaagaacattaactccagaggcaactaaagaaattgaattaattgaagaaaaaattcggtcagcacaagtaaatagaatagatcacttcgccccactccaacttttgatttttgctactgcacattctcaacaggcattattgttcaaaatacagatcttgtggagtgatctttccttcctgacagtacgattaagacttttacattgtacttggatcaaatggctacattaattggtcaggcaagattacaaataataaaattgtgtggaagtgacccagataaaatcattgttcctttaaacaaggaagagtttagacaaggctttatcaattctgctgcatggcagattgctcttgctgattttgtgggaattattgataaccattacccaaaaacaaaaatcttccagtttttaaaattgactacttgaattttacctaaaattaccagacataaacctttagaaaatgctctgacggtgtttactgatggttccagcaatggaaaagtggtttacaccaggccgaaagaacgagtcattgaaaatcagattctgcatatgtagcacagctacaaaggatgttgagacagccctaaccaaatatagtatggatgatcagtttaacaagccctttaatttgttacaacaaattgtaagaaaaagaaatttcccattttatattactcatatatgagcacatactaatttaccaaggcctttagctaaagcaaatgaacaagctgacttgctagcatcatctgcattcatagaagcacaagaacttcatgctttcactcatgtaaatgcaacaggactaaaaaataaatttgatatcacatggaaacaggcaaaaaatattgtacaacattgcacccagtgtcaagtcctacacctgcccactcaggaggcaggagttaatcccagaggcctatgtcctaatgcattatggcaaatggatgtcacacatgtaccttcatttggaaaattgtcgtttgtccatgtgacagttgatacttatttgcatgtctatgggcaacctgccagacaggagaaagtacttcccatgttaaaagacatttattatcttgttttgctgtcatgggagttccaaaaaaaaattaaaacacgtaatgggccaggatactgtagtaaaacattttaaaaattgtgaaatcagtgacaaattacacatataacaggaatcccctataattcccaaggacaggccataattgaaagaactaatagaacactcaaagctgaattggtgaaacaaaaaaaggaaaaagacattaaggagtataacactccccagatgcaacttaatttagcactctatactttaaattttttaaacatttatagaaatcagaccactacttctgcagagcaacattttactggtaaaaagaacagcccacatgaaggaaaactgatttggtggaaagacaacaaaaataagacaagggaaatagggaaaatgataacatgggggagaggttttgcttgtgtttcaccaggagaaaatcagcttcctgtttggatacccactagacatttaaagttctacaatgaacccatcggagatgcaaagagaagcgccaccacggagatggtggcatcatcgactcaccgggtgaacaaaatggtgacatcagaagaacagatgaagctgccatccaccaaggaagtggggccactgacctgggcccaattaaagaagctgacacagttagctgaaaaaagcctgaagaacaaaaagggtaacacaaactccagagaacatgctgcctgcagctttgatgattgtatcaacggtggtaagtctccctatgactgcagtagcagccacaactaatcatacttactgggcctgtgtgcctttcccgcccttaattcaggcagtcacatggatggataatcccattgaagtatatgttaataatagtgcatgggtaccaggcctcacagatgatcattgccctgcccaacctaaaaaagaattgatgataaatatttccactgggtatcattatcctcctatttgcctagggaaggtgccaggatatttaatgcctacaaccccaaattggttggtagaagtacctactgtcagtgccaccagtagatttacttatcacatagtaagtgggatgtcactcgggccacagataaaataatttacaggactcttcttatcaaagatcattaaaatttaggcctaaggggaagccttgccccaataaaattcccaaagaatcaaaaggcccaaaagtttcagtttgggaagaatgtgtgcctgatactgcggtggtactacaaaacaatgaatttggaactattatagaccaggcccctcgaggccaattttattataattgtacgggccagactcactcatgttcacagccccatccatctggcccattaatctggcctatgagagtgatttaactgaaaggctggatcaggtttatagaaagttacaatcaccctatccatggaaatgaggtgaaaagcgaatttcatcacctcgaccaaagttagttagtcctgttactggtcctgaacatccagcattatgaaagcttactgtggcctcacaccacattagaatttggtctgaaaatcaagctataggaacaagagatcataagccatattatactattaacctaaattccaatctgacaattcctttgcaaagttgtgtaaaacccccttatatgctagttgtaggaaacatagttattaaaccagattcccaaactataacctgtgaaaactgtagattgtttacttgcattgattcgacttttgattggcagcaccgtattctgctggtgagggcaagagagggcatgtggaaacctatgtccatggactgacagtgggaggcttccccatctgtccatattttaatagaagtattaaaaggagttctaactagatccaaaagattcttttttactttgattgcagtgattttgggtcttattgcagtcacagctactgctgtggctgctggaattgctttacacttctctgttcaaactgcagaatatgtaaataattggcaaaagaattcctcaaaattgtggaattctcagaaccaaatagatcaaaaattggcaaaccaaattaatgatcttagacaaactgtcatttggatgggagacaggctcatgagcttggaatatctttttcagttacagtgtgactggaatatgtcagatttttgtattaaaccccaagcctataatgagtctgagcatcaatgggacatggttagatgtcatctataaggaagagaagataatcttactttagatatttcaaaattaaaagaacaaatttttgaggcatcaaaagcccatttaaatttggtgccagaaactgaggcaatcgtgaaagctgctgatggcctcgcaaatcttaaccctgtcacttgggttaaaaccatcagaagttcaactattgtaatttcatattaatcctggtatatctgttttgtctgttgttagtctacaggtgtatccagcagctccaaagagagagcgaccagtgagaacgggccatgatgatgatggcggttttctcaaaaagaaaagggggatatgtagggaaaagaaagagagatcagacggttactgtgtctatgtagaaaaggaagacataagaaatttcattttgatctgtaccctgaacaattgctttgccctgagatgctgttaatttgtaactttagccccaaccttgagctcacagaaacatgtgttgtatggaatcgaggtttaagggatctagggctgtgcaggatgtgccttgtttacaaaatatttacaggcagtgtgcttgataaaagtcatcgccgttcttcattctcaagtaaccaggggcacaatgcactgtggaaagctgcagggacctctgccctggaaagccaggtattgtccaaggtttctccccatgtgatagtctgaaatatgacctcatgggatgggaaagacctgaccgtccccaagcccgacacccgtgaagggtctgtgctgaggaggattagtaaaagaggaaggcttcttgcagctgagataagaggaaggcctctgtctcctgcctgcccctgggaatgcaatgtcttggtataaaacccgactgtacatttgttccattctgagataggagaaaaaccgccttgtggcaggaggtgggacatgttgggagcaatgctgctttgttactctttactccattgagatgtttgggtggagaaaagcataaatctggcctatgtgcacatccaggcatagaaccttcccttgaacttatttgtgacacagattcctttgctcacatgttttcttgctgaccttctccccactatcaccctgttctcctgccacgttccccttgatgagatagtgaaaacagtaatcaataaaaactgagagaactcagagaccagtgctagtgcaggtcctccgtatgctgagcgccggtcccctgggcccaatttctttctctatactttgtctctgtgtcttatttctttcctcagtctctcatcccacctgaggagaagtaaccacaggtgtggagaggc

SEQ ID NO: 47 - DNA, 957 bp, Homo sapiens
gtagggaaaagagatagatttcagactgttactgtgtctacatagaaagaattagacataagagactccatttagttctgtattaagaaaattattatgccttgagatgctgttaatctgtatccctagccccaaccctgtgctcgcagagacatgtgctgtgttgactctaggtttaatggatttagggccatgcaggatgtgctttgtaaaaaagtgcttgaaggcaatatgcttgttaaaactcataaccattctctagtctcaagtacccagggacacaaaacactgcggaaggccacagggacctctgcctaggaaaagcaggtattgtccaaagcttctccccatgtgatagccttagatatggcctcatgggaagggaaagacctgaccatcccgacacccataaacggtctgtgctgagaaggattagtaaaagaggaaggcctctttgcatttgtgataagaggaagacatctgtctcctgctcatccctgggcaatggaatgtctcagtgtaaaacctgattgtatatgctatttactgagataggagaaaactgccttagggctggaggtgagatatgctagtggcaatactgctctttaatgcaatgagatgtttgtatatgtgcacatcaaggcacaacacatttccttaaacttgtttatgacacagagaactttgttcacatgttttcctgctgaccatctccccactattaccctattgtcctgccacatccccctctcaaagatggtggagataatgatcaataaatactgagggaactcagagaccagtgccagtgggggtcctccgtatgctgagtgctggtcccctgggcccacttttcttttctatactttgtctctgtgtctttttcttttctcaatctctcatcccacctgaagagaaatgcccacaggggcagaggggcatgccatcccttca

SEQ ID NO: 48 - DNA, 810 bp, Homo sapiens
gaaagcatacctctttgtcacctgactctactgaaggccaactaattttaaaggataagtttatcactcagtcagctgcagacattagaaagaaacttcaaaagtctgccctgggccccgagcaaaatttggaaactctattgaatttggcaacttcggtgttttgtaatagagatcaggaggagcaggctgaacgagacagatgagacaagaaaaaggcctccaccttagtcatggccctcagacagacgaacttcaaacttcggtggttctgaaagaaagaaaggctgggcaggcaacccgcctaacagagcttattatcagtgtggcttacaggaccacttcaaaaaggactgcccaaacaataagctgccccctcgtccatgtcccttgtgccagggggatcactggaaggcacactgcccccgagggcgaaggttcactgggccagaggccactaaccagatggtaccacaacaggactgagggtgcccggggcaggcaccaacccatgccatcaccatcacagagagccccaggtaagtttaaccattgagggccaggaaactaacttcctcctggacactggcacggccttctcagttttactcttctgtcccggataactatcctccaggtctgtcaccatcaaaggggtcctaggacagccaatactaggtatttctcccaccccctaagttgtgactggggaaccttatttttctcacatgcctttcttatcatgcctgagagccctactcctttactagggagggacatattagctaaagcaggggccattatatactt

SEQ ID NO: 49 - DNA, 4311 bp, Homo sapiens
gagagacaggactagctggatttcctaggccgactaagaattcctaaccctagctggggaaggtgactgtatccacctttaaatatggggcttgtaactcagctcacacctgaccaatcaggtaacagagagctcactaaaatacccgttaagctaaaagcaggaggtaaagaaatagtcatctatcgcctgagagcacagggggagggacaactatcaggatataaacctaggtattcgaactggcagtggcaaccccctttggatcccctcccattgtatgggagctttgttttcactctattaaatcttgcaactgcacactcttctggtccatgtttgttagggctcaagctgagctttcactcgccgtccaccactgctgaacgtcgccgtcgcagacccgccattgactttcaccgctctggatccggcaaggtgtctgctgcgcttctgatgcagcaaggcgcccattgccgctcctgatcaggctagaggcttgccattgtttctgcgcggctaagtgcatgcattcatcctagtagagctgaacactagtcgctgggttccacggttctgttctgtgacccacggcttctaacagagctataacactcccctcgtggcccaaggttccattccttggaatccttgaggccaagaaccccaggtcagagagcaaaaggcttgctgctatcttgggagcagcctgccatcatcttgagagctctaagaacaaagacccaccagtaacatctggtggcctgtacagggattctccaaagccctgagtaatactggaccactttgacttgctattctgtcctatccttccttagaatcagaggaaaatactgggcagctgttgaccatttaaaaatgattagcatggctgctggacttaagactcaggtgtgaggctttctgggaaaaggcgaacagcccccatctgagttgggagcattggtctgcctggaaccagcttccgcttttacaattttcctggggaagctgagggccgactagaagcagaaaactgtcatcctgaattcccggcattggccagtcgagatcatggtgcagccagaagtctctactccacagtcgcccatgcaggcacccctacctctccttttgacccatacctcctgggtcccaaccaccactttcttgaaagtgtagccccaaaattctccttacctctgaatctacttcctccagtccctgcctcctaggtactaatgcttcagactttcactccctctcccaggtattagagcaagttgtatctccaaagggatctagagaagctctacactgcatccttaggcacctaggctatgaacccagggagtcttgcccctggtgtctctcccaatttaggtatacagccctcgacgtgggtagttaggtgggacccgttcctcaccacccttgccagggccccaaatttgtaaatggctaggaggattgctctcccattgtgtaagatgctctcctcccccaatttctacccagcttacccccacctgcaatgcaatctccaagcctcagctccttggccagggccttagaactggtaacccagtactttaacaactggaactgggtctacaacaacataatagatcaggatgaaagcaaattgaataaattaaagggaggagcatattcctatagtggcaaatgggggcaacgagcaaatgtccttctgctgtgttcccaaaatccatctaccaaagggaagggagaaagagaggggaaaaagagagaaagaggtagagaaacaaagggagtcagagagagacagaaagtcagagagagaaagaaagagaagtagtaaagaaaaaagtgtaccctattcctttaaaagccagggtaaatttaaaacctataattgataattgaagatcctctccgtgaccctgtaacactccaataccaccttgttatcagtgtaaacaagggtgtagccaaaagcgctgaggccactgacaacccgtagccttcctatcaaaaatccttaacccaataacccacagatggctcaaatgcattcaatctgtagcagcaactgctttgctagcagaagaaagtagaagaataactttagaggaaacctcattatgagcatacctcaccagttcagaaataccctaagtaaaaaaggcaaaaaggtagcttactgactcaaaaatcttaaagtatcgggctgttctttagaaaaagatgatttaacattaaccactgaaaattcccttaacccagcagatttcctaacgggatttaaatcttattactatacaaagttctaaccagacctaggaggaacttccttgaggacaggacaataaatagttcctcccgggtgattgagggaaaaaaacacaatgggtattcagtaattgataggaaaactcttgtagaagcagagttagaaaaattgtctaataattggtctgctcaaacgtgcgagctgtttgcactcagccaagccttaaagtacttacagaaccaggaaggaaccatctataccaattctaagttaatttagactaaacaaagtcttagtaatagcaaaggacctaaaagcccaaggccatgcaatagcccctgcagtactccaattttaggagtgcagaagcccaacggacagtggaggttagtgcaagatctcaggattatcaatgaggccgttgtccctctatacccagctgtacctaacccttatactctactttcccaaataccagaggaagcagaatggtttacagtcctggaccttaaggatgcctttttctgtatccctgtacatcctgactctcaattcttgtttgcctttgatgatccttcgaaccaacatctcaactcacctggactgttttaccccaagggttcagggctagcccccatctatttggccaggcattagcccaagacttgagtcagttctcatacttggacactcttgtcctttggtatgtggatgatttagttttagccacctgttcagaaaccttgtgccattaagccacccaaacactcttaaagttcctcgccacctgtggctacaaggtttccaaaccaaaggcttacctctactcacagcaggttaaatacttagggctaaaattatccaaaggcacctgggccctcactgaggaacacatccagcttatactggcttatgctcatcccaaaaccctactaactgttggatgtgcctcaccctgcacttcaggccatacatttcaatccctgtatctttaacctccttgttaagtttgtctcttccagaattgatgctgtaaaactacaaatcgttctttaaatggagccccagatgcagtccatgactaagatctaccgtggacccctggaccggcctgctagcccatgctctgatgttgatgacatcaaaggctcccctaccgaggaaatctcaactgcacaacccctactatgccccagttcagcaggaagcagttagagtggtcgtcagccaacctccccaacagcacttgggttttcctgttgagaggggggactgagagacaggactagctggatttcctaggccgactaagaattcctaagcctagctggggaaggtgacctcacccacctttaaacatggggcttgtaactcagctcacacctgaccagtcaggtagtaaagagagctcactaaaatgcccattaggctaaaagcaggaggtaaagaaatagtcaatcatctatcacctgagagcacccggggagggacagtgatcaggatataaacccaggcattcgaaccagcagtggcaagcacctttgggtcccctcccgttgtatgggagctttggtttcactctgttaaatcttggaaccacacactcttctggtccacgtttgttactgttcgagctgagcttttgctcaccatccaccactgctgaatgccaccttctcagactggccattgactttcacccctctggatctggcaccgtgtccgctgcgcttctgatccggggaggtgcccattgccgctcccgatcaggtagaggctcgccattgtttctgtgcggctaagtgcgcgggtttgtcctactcgagctgaacacttgtctctgggttccacagttctcttccgggacccacagcttctaatggagttgtaacactcaccgcatggcccaaggttccattccttggaatccgtgaggccaagaaccccccaggtcagagagcaaaaggcttgctgccatcttgggagcggcccaccaccatcttgggagttctaagaacaaacacctgccagtaaca

SEQ ID NO: 50 - DNA, 5575 bp, Homo sapiens
gtcagacctctgagcccaagctaagccatcgcatcccctgtgacttgcacgtatacatccagatggcctgaagtaactgaagatccacaaaagaagtaaaaatagccttaactgatgacattccaccattgtgatttgttcctgccccaccctaactgatcaatgtactttgtaatctcccccacccttaagaaggttctttttaattctccccacccttgagaatgtactttgtgagctccacccactgtctgcaaaacattgctcttaacttcagcgcctatcccaaaacctataagaactgatgataatccaccaccctttgctgactctcttttcggactcagcccgcctgcacccaggtgaaataaacagccatgttactcacacaaagcctgtttggtggtctcttcacacggacgtgcatgaaatttggtgccgtgactcggatcgggggacctcccttgggagatcaatcccccgtcctcctgctctttgctctgtgagaaagatccacctacgacctcaggtcctcagactgaccagcccaagaaacatctcaccaatttgaaatccggtaagcagcctctttttactctcttctgcaacctccctcactatccctcaacctctttctcctttcaatcttggcaccacatttcaatctctcccttctcttaatttcaattcctttcattttctggtagagacaaaggggacacgttttatccgtggacccaaaactccggcgccggtcacggactgggaaggcagccttcccttggtgtttaatcattgcaaggatgcctctctgattattcacccacgtttcaagggtgtcagaccacacagggacgcctgccttggtccttcacccttagcggcaagtcccgcttttctggggaaggggcaagtaccccaaccccttctctccttgtctctatcccttctctgcttttctggggaaggggcaagtaccccaaccccttctctccgtgtctctaccccttctctccgtgtctctaccccttctctgcctttctgggggaggggcaagtacccctcaaccccttcttcacccttagcggcaagtcccgcttttctagggggcaagaacccccaattccttatttccacaccccgacctcttatctctgtgccccaattccttatttctgcaccctgacctcttatctctgtgccccaatcccttatttctgcaccccgacctctcaactctgtgccccaatcccttatttctgcaccccaacctcttatctctgtgccccaatcccttatttccgtgccctgaccccccttcccgcttttctggagggtaagaacccccgaaacccttccctccatgtctctacattctcttttctctaggtttgcctccttcactatgggcaaccttccaccctccattcctccttcttctcccttagcctgtgttctcaagaacttaaaacctcttcaactcacacctgacctaaaacctaaatgccttattttcttctgcaatgccgcttgaccccaatacaaactcgacagtagctccaaatagccagaaaacggcactttgaatttttccatcctgcaagatctaaataattcttgtcgtaaaataggcaaacggtctgagttgcctgacgtccaggcattcttttacacatcagtcccttcctagtctttgtccccaatgcaactcgtcccaaatcttccttctttcccttccgcctgtcccctcagtcccaaccccaagcgtcgctgagtctttctaatcttccttttctacagacccatctgacctttcccctcctccccaggctgctcctcgccaggccgagctaggtcccaattcttcctcagcctctgctcctccaccctataatccttttatcacctcgcctcctcacacctggtccagcttacagtttcgttccgtgactagccctcccccacctgcccagcaatttactcttaaaaaggtggctgaagctaaaggcatagtcaaggttaatgctcctttttctttatcccaaatcagaagcatttaggctctttttcatcaaatataaaaacccagcccagttcatggctcgtttggcagcaaccctgagacgctttacagccctagaccctaaaaggtcaaaaggccgtcttattctcaatatacattttactacccaatctgctcccgacattaaataaaactccaaaaattggaatctggccctcaaaccccacaacaggacttaattaacctcaccttcaaggtgtacaataacagaaaaaagttgcaattccttgcctccactgtgagacaaaccccagccacatctccagcacacaagaacgtccaaacgcctgaaccacagcagccaggggttcctccagaacctcctcccccaggagcttgctacacgtgccggaaatctggccactgggccaaggaatgcccgcagcccgggattcctcctaagctgcgtcccatctgtgtgggaccccactgaaaatccgactgttcaactcacctggcagccactcccagagcccctggaactctggcccaaggctctctgactgactccttcccagatcttctcggcttagcagctgaagactgacactgcccgattgcctcggaagccccctaaaccatcacggatgccgagcttcaggtaactctcacggtagaaggtagtaagcgcgtccccttcttaatcaatacggaggctacccactccacattaccttcttttcaaaggcctgtttcccttgcctccataactgttgtaagtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacagccacatctcattgccgcccttcttcccaatccaaagcctcctttgcgtcctcctcttgtatccccctaccttaacccacaagtataagatacctctactccctccttggtgaccgatcatgtaccccttaccgtctcattaaaacctaatcacccttaccccactcaatgtcaagatcccatcccacagcacgctttaaaaggattaaagcctgttatcactcgcctgctacagcatggccttttaaagcctatgaactcttcttaccattcccccattttacctgtcctaaaaccagacaagccttacaagttagttcagaatctgcgccttatcaaccaaattgttctgcctatccacccggtggtgccaaacccatactcgatacctccctctactacccattattctgttctagatctcaaacatgctttctttactattcctttgcacccttcatcccagcctctctttgctttcacttagactgaccctgacacccattaggctcagcaaattacctcggctgtactgccgcaaggcttcacagacagcccccattacttcagtcaagcccaaatttcatcctcatctgttacctatctcagcataattctcataaaaatacacgtgctctccctgctgatcgtgtctgattaatctcccaaacctcagtcccttacaaaataacaactcctttccttcctaggcatggttagtgcagtcagaattcctacacaagagccaggacaggactgcaccctgtagcctttctgtccaaacaacttgaccttactgttttagcctagccctcatgtctgtgtgcagcggctgccgctgctttaatactgttagaggccctaaaaatcgcaaactatgctcaactcactctctacatttctcataacttccaaaatctattttcttcctcatacctgacgcatatactttctgctccccagctccttcagctgtactcactctttgttaagtcccacaattaccattgttcctggcccggacttcaatctggcctcccacattattcctgataccacacctgacccccatgactgtatctctctgatccacctgatattcaccccatttccccatatttccttctttcctattcctcaccctgatcacgcttgatttattgatggcagttccaccaggcctaatcgccacacaccagcaaaggcaggctatgctatagtacaagtcactagcccgcctctcagaacctctcatttcctttccatcgtggaaatctatcctcaaggaaataacttctcagtgttccatctgctattctactactcctcagggattattcaggccccctcccttccctacacatcaagctcaaggatttgcccccacccaggactggcaaattagctttactcaacatgtcccgagtcaggaaactaaaatacctcttagtctaaatagacactttcactgaataagtaaaggcctttcctacagggtctgagaaggccaccacagtcatttcttcccttctgtcagacataattcctcagtttagccttcccacctcaatacagtctaataacagaccatcctttactagtcaaatcagccaagcagcttttcaggctcttagtattcagtgaaacctttatatcccttacggtcctccatcttcaagaaaaggagaacggactaaaggtcttttaaaaacacacctcaccaagctcagccaccaacttaaaaaggactggacaatactttcaccactttcgtttctcagaattcaggcctgtcctcagaatgctacaaggtacagcccatttaagctcctgtatagacgctcctttttattaggccccagtcccattcgacaccagaccaacttagactgtgccccaaaaaaacttgtcatccctactatcttttgtctagtcatactcctattcaccattctcaactactcatacatgccctgctcttgtttacactgctggtttatactgtttctccaagccatcacagctgatatctcctggtgctatccccaaactgccactctaaactcttgaagtaaataaataatctttgccggcaggactatgctgaatctccttaggcactctctaatcagatgtcctaggtcctcccaattcttagaccttttatacctgtttttctccttctcttattccatttagtttctcaattcatccaaaaccatatgcagtccatcaccaatcattctatacgacaaatgtttcttctaacatccccacaatatcaccccttaccacaagacctcccttcagcttaatctctcccactctaggttcccacgccgcccctaatcccgcttgaagcagccctgagaaacatcgcccattctctctccattccaccccccaaaaattttcgccgccccaacacttcaacactattttgttttatttttcttattataagaaggcaggaatgtcaggcctctgagcccaagccaagccatcgcatcccctgtgacttgcacgtatacatccagatggcctgaagtaactgaagatccacaaaagaaataaaaatagccttaactgatgacattccatcat

SEQ ID NO: 51 - DNA, 2930 bp, Homo sapiens
aactcagatcgggggacctcccttgggagatcaatcccctgtcctcctgttctttgctccatgagaaagatccacctatgacctcaggtcctcagaccaaccagcccaaggaacatctcaccaattttaaatcgggtaagcggcctcttcttactctcttctccaacctctctcactaaaccctcaaccactttctcctttccactcttcaatctctcccttctcttaatttcaattccttttgttttctggtagagacaaaggagacacgttttatccgtggacccaaaactccggcaccagtcacggaatagggaaggcagccttcccttggtgtttaatcattgctgggatgcctttctgattattcaggtgtcagaccacgcagggacgcctgccttggtccttcacccttagcggcaagtcccgcttttctggggaaggggcaagtaccccaaccccttatatctctgtgccccgatcccttatttccgcaccccaacctcatatctctgcgccccaatcccttatgtccgcaccccgacctcgtatctctgtgccctgacccctttcccgcttttctggagggtaagaacccccgaaccccttccctccatgtctctactctctcttttctctgggcttcactatgggcaaccttccaccctcaatttctccttattctcccttagcctgtgttcttaagaacttaaaacctcttcaactctcacctgacctaaaatctaagtgtcttattttcttctgcaatgccgcttgaccccaatacaaagtcgacagtagttccaaatagccagaaaacgacactttcaatttttccatcctgcaagatctaaataattcttgtcgtaaaataggcaaatggtctgagatgcctgacgtccaggcactcttttacacatcggtccctttccagtctctgttcccaatgcaactcatcacaaatcttccttctttccctcccacctgtcccctcagtcccaaccccaagcgtcgctgagtctttctaattttccttttctacagacccatctgacctcttcccttctccccaggctgctcctcaccaggctgagctaggtcccaattcttgctcagcctctgctcctccaccctataatccttttatcacctcccctcctcacacccggtccggcttacagtttcgttccatgactagccctccccctcctgcccagcaatttactcttaaaaaggtggctggagctaaaggcatagtcaaggttaatgctcctttttctttatcccaaatcagatagcgtttaggctctttttcatcaaatataaaaatccagcccagttcatggctcgttcggcagcaaccctgagacactttacagccctagaccctaaaaggtcaaaaggccgtcttattctcaatatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacataagaacttccaaacgcctgaaccgcagcagcccggcattccaccagaacctcctcccccaggagcttgctacaagtgccagaaatctgaccaccaggccaaggaatgcctgcagcccaggattcctcctaagccatgtcccatctgtgcgggaccccactggaaatcagactgttcaactcacctggcagccactcccagagcccctggaactctggccgaaggctctctgactgactccttctcggcttagcggctgaagactgacgctgcctgatagccttggaagccccgtagaccatcacggacgccgagccttaggtaactctcacagtggagggtaagtccgtccccttcttaatcaatacggaggctacccactccacattaccttcttttcaagggcctgttgcccttgcctccataagtgttgtgcgtattgacagccaggcttctaaactaaaactccccaactctggtgccaacttagacaatactcttttaagcactccttttagttatccccacctgcccagttcccttattaggccgagacactttaactaaattatctgtttccctgactattcctggattacagctacatctcattgccgcccttcttcccaatccaaagcctcctttgcgtcctcctcttgtatctccccaccttaacccacaagtataagatacctctactccctccttggcgaccgatcatgcaccccttaccatctcattaaaacctaatcacccttactccgctcaatgccaagatcccgtcccacagcacgctttaaaaggattaaagcctgttgtcactcgcctgctacagcgtggccttttaaatcctataaactcttcttacaattcccccattttacctgtcctaaaaccagacaagccttacaagttagttcaggatctgcatcttatcaaccaaattgttttgcctatccaccccatggtgccaaacccatatactctcctatcctcaatacctccctccacaatcccttattctgttctggatctcaaacatgctttctttactattcctttgcacccttaatcccagcctctcttcgatgtcacctggactgaccctgacacccattaggctcagcaaattacctgggctgtactgccgcaaggcttcacagacagcccccattacttcagtcaagcccaaatttcttcctcatctgttacctatctcagcataatgctcataaaaacacacgtgctctcccagctgatcatgttcgattaatctcccaaacctcaatcccttacaaaacaacaactcctttccttcctaggcatagttag

SEQ ID NO: 52 - DNA, 975 bp, Homo sapiens
gtggggaaaagaaagagagatcagattgttactgtgtctatgtagaaaaggaagatataagaaactccattttgatctgtactaagaaaaattgtttctgctttgagatgcgttaagctgtaactttagccccaaccctgtgctcacagaaacatgtgctgtattgaatcaaggtttaatggatttaggaatgtgtgggatgtgccttgttaacaatatgtttgcagtatgcctggtaaaagtcatcaccattctccattctcgattaaccagggacagaatgcactgcggaaagccacagggacctctgcccaagaaagcctgggtattgtccaaggtttccccccactgagacagcctgagatatggcctcatgggaagggaaagacctgactgtcccccagcccaatacccataaagggtctgtgctgaggaggagtagtgaaagagggaggcctctttgcagttgggataagaggaaggcttctgtctcctgctcatccctgggaatgcaatgtcttggtgtaaagctgaccattcccattcattctattgagataagagaaaaccacccggtggctggaagcgagatatgctggcagcaatactgctctgttactctttgctaaactaagatgtttgggtaaagagaaacataaatctagcctgtgtgcacatctgggcacagtacgtttccttgaacttattcatgatacagattcctttgctcacatgtttctgtgctgaccttctcccaacctgttgccctgctacactcccctcactaagatagtaaaaataatgatcaataaatactgagtgaactcagaggccggcgtcagtgcaggtcctccgtatgctgagcgctagtcccctgggcccactgttctttctctatactttgtctctgtgtcttatttcttttctcagtctctcgtccaacctgatgagaaatacccacaggtgtgggggggc

SEQ ID NO: 53 - DNA, 8094 bp, Homo sapiens
gtcaggcctctgagcccaagctaagccatcatatccccagggacctgcacgtatacatccagatggcctgaagcaactgaagatccacaaaggaagtgaaaatagccttaactgatgacattccaccattgtgatttgtttctgccccatcctaactgatcaatgtactttgtaatctctcccacccttaagaaggttcttcgtaattctttgtaatcccacccttgagaatgtactttgtgagatccaccccctgcctgcaaaacattgctcctaactccaccgcctatcccaaacctacaagaactaatgataatcccaccacactttgctgactctctttttggactcagcccgcctgcacccaggtgaaataaacagccttgttgctcacacaaagcctgtttggtggtctcttcacacggatgcgtgtgacgtgcgtgacatttggtaccaaagatccgggacgggagtactccttacagagaccggtcccctgtcctcatcctcactccatgaggagatccacgtacaacctcgggttctcagaccaaccagcccaaggaacatctcatgaatttcaaatcgggtaagtggtcttttcactctcttctccagcctctctcgctacccttcagtctccctgtccttccaattccagttctttttcctctctagtagagacaaaggagacatattttatccgtggacccaaaactccggcgccagtcacggactcggcaagacagtcttcccctggtgtttaatgactgcagggacgcctgcctgattattcacccacactccactggtgtctaatcactgtggggatgcctgccttggtcattcacccacattcccttggtggcaagtcaattgcggggacaacctgctttggctgctcacccacattgcagcccacggctgctccctaccccccttctccgtgtctctacccttctctttaaactggcctccttcactgtgggcaacctttcaccctccattcctccttcttctcccttagcctgtgttctcaagaacttaaaacctcttcaactctcacttgacctaaaatctaagcatcttattttcttctgcaacaccgcttggccccagtacgaactcgacaatggttctaaatggccagaaaatggcacttttgatttctccatcctgcaagacctagataatttttgtcgaaaaatgggcaaatagtctgaggtgccttacgtccaggcatttttcagacttcgttccctccctagtctctgttcccactgtgactcatcccaaatcctcctcctttccctcccgcctgtcccttcagtcccaacctcgagcgttgctgagtcttgtgaatcttccttttctgctgacccatctgacccctcacctcctccccaggctgctcctcctcagctcgctccccgccaggctgatcaggctccagctcttcttcagcctctgctccccaccctataacccttctattacctccctcccacacccggtccggtttacagtttctttctgcgaccagctctcccccatctgcccaacaatttcctcatagagaggtggctggagctgaaggcatatgtcagggtacatgtgcctttttctctatcagacctttcccaaatcagccagcgtttaggctctttctcatcagaccccactaaatacatacaggaattccgatatctaactctgtcctacagtttaacctggagtgactgaaatgtcatcctaacttctaccctctccccagataaatgggaaagagttttttctctagcccaatctcacactgacaaccaccggcttcacgagccagacctccaggagggcatcagagcagttccccgagaagatccccagtggaactaccaggcagattccccaggtatagctacgcgagattacatggtttcctgcctagttgaagggcttaaaaaggcagcttacaaagctgttaattatgacaaacaagaaactacccgaggtgaagatgaaaacccagcccagttcatggcccacttggcagtaacccttagacgctttaccgccctagacccagaggggccaggaggccgccttattcttaatatgcattttatcacccagtcagctcctgatgttagaaaaaagattcaaaaactggaatccagccctcataccccacaacaggaattaatcaacctcaccttcaaggtgtacaataataggaggtagccagacagcaacgcatttctgagttacagctactcgcctctgctgtaagacagcccacaaccacgtctccagcatacaagaacttcagaacatccaagccacagctcccaggggctccttcaaaacatcctcgtgggccttgcttcaaatgccaaaagcctggccactgggccaaggaatgcccgcagcctgggattcctcctaagctgtgccctgtctgtgcgcgcccccactggaggtcggactgtccgactcacatcgccgctgctcctaaagcacctggagcccaaacccaacgttccttggccaactccttcccagatctcctcggcttagtggctgaagactgacgctgcccatcgcctcgggagcccctggaccatcacagacactttgggtaactcttacagtggaggataagtctgtccctttcttaatcaatacagaggctacccactccacattaacctttttttcaagggcctgtttcccttgcctccgtaactgttgtgggtattggcggccaggcttctaaacctcttaaattccccaactctggtgccaacttggacaacattcttttatgcacccctttttagttatccccacctgcccagatcccttactagattgagacattttaactaaattatctgcttccctgactattcctagcctacaaccacacctcattgccacccttttctccagttcaaagccgccttcacaccctccccttggatctccccaccttaatccacaagtataggacacctctactcccaccttggcaaccaatcatgcaccccttaccatcccattaaaacctaatcactcttaccccactcaatgccaatatcccatcccacagcacactttaaaaggattaaagcctgttatcactcgcctgttatagcatggccttttaaaacccataaacactccttataattcccccattttacctgttccaaaaactggacaagccttacaggttaatttcagaatctgcaccttatcaaccaaattgtcttgcctatccaccctgtggcgccaaagccatatactcttctatcctcaatacctccctccagaacccctctacatatattattatgtagatatgtacatatctacatatgtacataatctacataacccattctgttctggatctcaaacatgctttctttactattcctttgcacccttcatcccagcctctcttcattttcacttggactgacccggacacccatcaggctcagcaaattacctgggctgtactgccacaaggcttcacggacagccccccccccccccgttacttcagtcaagcccaaatttcttcctcatcctttacctatctcgacttaattcttcatgaaaacacagtgctctccctgctgatcgtgtctagctaatctcccaaaccccgaccccttctacaaagcaacagctcctttccttcctaggcatggttagatactccgcctttggatacctagctttaccatcctgactaaaccatcatataaactcacaaaagcaaacccagctgaccccacagatcctaaatcctttcgccactcctctttccgttccctgaaaacagccctagaagctgctcccacactagctctccctaactcatcccaacactttttcattacatacagccaaagtgcagggttgtgcagtcagaattcttacacaagagccaggaacggcccctgcagcccttctgtccaaacaacttgaccttactgttttaggctagcccccacattattcctgataccacacctgaccccccatgactgtatctctctaatccacctagcatttactcaatttccccatatttccttctttcctgttcctcaccctgatcacacttggtttattgatggcagttccaccaggcctaatcgccactcaccagcaaaggcaggctatgctatagtaacttccacacctatcattgaggctaccactctgcccccctccactacctctcagcaagccaaactcattgccttaactcaagccctcactcttgcagaaggagtacgtgtcaatatttatactgactctatgccttccatagagtcagcatgcaccaccatgctgttatatgggcagagagaggtttcctcactatgtaagggtcctccatcattaatgcctctttaataaaaattcttctcaaggtcgctttacttccaaaggaatctggagtcatttactgcaagagccatcaaaaggcatcagatcccatcattcagggcaacacttatgctgataagttagctaaagaagcagcttagttttccaacttctgtccctcacggccagtttttctccttctcatcggtcactcctacctactctcccactgaaacttccacctatcaatctcttcccacacaatgtaaatggttcttagacaaaggaaaatatctccttccagcctcacaggcccattctattctatcatcatttcacaacctcttccatgtaggttacaagccgctagcctgtctcttagaacctctcatttcctttccatcgtggaaatctatcctcaaggaaatcacttctcagtgttccatctgctattctactactcctcaaggattgttcaggccccctccctccctacacatcaagcgcggggatttgcccctgcccaggaccggcaaattgactttactcacaggccccgagtcaggaaactaaaatacctcttggtctggatagatgctttcactggatgcgtagaggcctttcccacagggtctgggaaggccaccgcagtcatttcttctcttctgtcagacataattcctcggtttggccttcccacctctatacagtctgataacggaccggcctttattagtcaaatcacccaagcagtttctcaggctcttggtattcagtggaaccttcatatcccttaccatctcaatcttcaggaaaggtagaagggactaatggtcttttacagacacacctcaccaagctcagcctccagcttaaaaaggactggacagtacttctacctcttgcccttctcagaattagagcctgtcctcaagaagctacacggtacagtccatttaaacttttatgtggacgcactttcttgctcagccccaacctcatcccagacaccagccctctaggcaactatcttccagtctttcagcaggctagacaggaaattcgccaggctgctaatcttctcttgcctactccagattcccagccacatgaagacaccctagctggatggtcagttcttgttaataatctgacccctcaaactctacaacctcgatggaccggaccctacttaaacatctatagtacccccaaccaccatctgcctgcagaaccctccccactgggttcaccgttccagaataaagctgtgtccgtcagacagccagtccgatatctcctcttcctcctggaagtcgcaagtactctcccctacttcccttaaactcactcgcatttctgaagaacaataacccttatgagcctaatacatcccttcattctattaggtctatccatccttaccctactcttcgcaacagggctttacgcagtcacccccactacttggactgtgccccaaaaacctgtcatccctactatcttctgtctagtcatactcctattcaccattctcaactactcataaatgacctgctcttgtttacactgccagtttacattgtttctccaagacatcacagctgatatctcctggtgatatccccaaaccgccactcttgactcctgcttggagtggatagatgatctttggtggcagggcaccctccaacacttccaccctgatgaagttctattctttacttttatattcactcttattctcattcccattcttatgccactctctacctctccccagttacctccagcatactatcaatctcacccactctctcctcactgcctccaatccttttctagcaaagaattgttggctacgcgtttccctttcctcctgcttttacacagccatccctgctctacaggctgactgggctacctctcccgtctccctgcaactcagaacctcctttaataaccctcatctttacccgcctgaggaacttctttattttctagacagatttggtgagaactccccagacatttcacaccaacgagctgccacacttctccgcatctacttacggcatctttctccttatgtcaattccactcctcccatatttggaccccaaccacacaaacaactatccctgttgccgtttctttatgcatctcccgacaacagcctgctggaatccctttaggcaaccttccaccgtccaaatgttcctttactctttgtctccagaacccagccacacacattaccaaacagatgggagcattccaacttcgcattactgacaagccctctatcattattgacaaactaaaaaacattggcagtcactattgtttaggaagacacctaccctgcatctcaccccatccttggctaccaccctcccctgctcgtctgaatctcctcctagcccctcctcttgcttgcttataccctgccccatgaatagcagcgaaaggttacttgtagacactatgcgctttctcatacaccatgaaaaccaaacccctccctctacgcagttgcaccatcaatccccattacaacctctaacggctgctgcccttgctggatcgctaggattctggatgcaggattcctctttcagtacaccctctcaccttttcactttacatttccagttctgcctgacacaaggtctcttctttttatgtggctcttccacctacatgtgcctacctgccaaatggatgggcacatgtactctagtcttccttacctccaaaatccagtttgcagatgggaacgaacaactgcctgtccccctcatgacatcaacacaacaaaaaagagtcatcccactaatccctttacttattggtctaggactttctgcctccagtattgcacttggaactggaatagcaggcatctcaacctctgtcacaacagtccgcagcctctctaatgacttctctgctagcactacagatagatcacaaactttatctgttctccaagcccaggttaactctttagctgcagttgtcctccagaacggccaaggccgcgatttactcactgctgaaaaaggaggactctgtatatttttaaatgaagagtgttgtttttacctaaatcaatctggcctgctatatgacaacataaaaaaactcaaggatagagcccaaaagctcgccaaccaagcaaacaataacattgaacccccttggacactctctaattggacgtcctgggtactcccaattcttagtcctttaatacctatttttctccttcttttattcggaccttgtgtctttcgtttagtttctcaattcatataaaaccgcatccaggccatcatcagtaattctatatgacaaatgctccttctaacaaccccaaaatctttcttcagttgaatctctcccactgtaggttcccacaccgcccctgatcccgctcgaagcagccttgagaaacatcgcccattatctctccataccacccccaaaatttgtcactgctccaacacttcaccactattttgttttgcttttcttattaatataagaagacaggaatgtcagccctctgagcccaagctaagccatcatatcccgtgacctgcatatacatccagatggcctgaagcaactgaagatccacaaaggaagtgaaaatagccttaactgatgacattccaccat

SEQ ID NO: 54 - DNA, 3054 bp, Homo sapiens
gctttgggtaacttacagtggagggtaagtccatccccttcttaatcaatacagaggctaccaagtccatattaccttcttttcaagggcatgtttcccttgcctccataactgttgtgggtattgacggccaggcttctaaatctcttaaaactccccaactctggtgccaacttggacaacattctttaatgcactcctttttagttatccccacctgcccagctcccttatcaggtggagatattttaactaaattatctgctgccctgactattgctgggctatagccacaactcattgctgccttttgtcccagttcaaagccttcttcacatcctctccttgtatatccccaccttaatccacaagtataggatacctctactccctccttggcaatggatgatgcacccgttaccatcccattaaaacctaatcacccttaccccactcaatgccaacatcccatcccacagcatgctttaaatggattaaagcacttgcctgttacagcatggccttttaaagccaataaactctccttacaattccctcattttacctgtccaaaaaccagacaagccttataggttagttcagtatctgtgccttatcaaccaaattgtcttgcctgtccactccatggtgtcaaaaccatatactctcctatcctcaatgcctccttccacaacccctccataacccattattctgttctggatatcaaacatgctttctttattgttccattgcaccttttatcccagcctctctttgctttcacttgcactgaccctgacacccatcagcctcagcaacttacctgggctgtactgccgcaaggcttcgcggacagcccccattacttcagtcaaacccaaatttctccctcatctgttacctatctcagcataattcctcatgaaaacacatgtgctctccctgttgattgtgtctggctaatctcccaaacccaaccccttctacaaaacaacaactcttttccttcctaggcatggttaggtacttccgcctttggatacctagttttaccatcctgactaaaccattatgtaaactcacaaaagcaaacctagctgaccccatagatcctaaatccttttgccgctcctctttctgttccttaaaaacagccccagaagctgccccaatgctggctttccctaactcatcccaacccttttcattacacacaggcaaggtacagggctgtgcggtcaaaattcttacacaagagccaggaccatgccctgtaggctttctgttcatacaacttgaccttactgttttaggctggcccccaccccagtgactatatctctctgatccacctgacattcactccatttccctgtagttccttctttcatgttcctcaccctgatcacacttggtttattgatggcagttccaccaggcctaatctccactcaccagcaaaggcaggctatgctagagtatcttccacatctatcattgaggctaccactctgcccccctccattacctctcagcaagctgaactcattgccttaacttgagccctcactcttgcaaaggaattttgtgtcaatatttatagtgactctaaatatgccttccatatcctgcaccaccttgctgttatatgggctgaaagaggtttcctcactatgcaagggtcctccatcattaatgcctctttaataaaaactcttctgaaggccactttacttccaaaggaagctggagtcatacactgcaagggccaccaaaaggcatcagatcctatcactgagggcaacgcttatgctgataaggtagctaaagaagcagccagcattccaacttccatccttcatggccagtttttctccttctaattggtcactcctatttactctcctactgaagtttccacctatcaatctcttcccacacaaggcaaatggttcttggaccaaggaaaatacctccttccagcctcacaggcccattctattctgtcatcatttcataacctcttccatgtaggttacacactgttagctcctctcttaaaacctctcatttcctttccatcatgaatatctatccccagtcctccactcttgactccctcttggagtggatagatgatctttgctgacaggacacactccaacactttcaccctgatgaagtcctattctttacttttatactcactcttattctcattcccattcttatgccaccctctacctctcctcagctatctccaccacactatcaatctcactcactctctcctagccatttctaatccttctttaacaaacaattgctggctttgcatttctctttcctccaaaatcactgaggcctcaatttactcactgctgaaaaaggaggattctgtgtatttttaaattaagaatgttgtttttacctaaatcaatctggcctggcatatgacaacataaaaaaactcaaggatataaaaactcaccaaaaaaccgcccaaaactcaccaaccaaacaaataattatgctgaacacccttgggcactctctaattggatgtcctgggtcctcccaattcttagtcctttaatacctgtttttcttcttctcttattcagaccttgtgtctttcgtttagtttctcaattcatacaaaaccgcatccaggccatcaccaataattctatacaacaaatgcttcttctgacaactccacaatatcactccttaccccaaaatctttcttcagtttaatctctcctactctaggttcccacaccgcccctaatcccacttgaagcagccctgagaaacatcacctattatctctccataccacccccccaaatttttgctgccccaacacttcaccactattttgttttgtttttcttattaatatatgaagacagaaatgtcaggcctctgagcacaagctaagccatcatatcccctgtgaactgcgtgtatacatccagatggcttgaagcaactgaagatccacaaaagaagtgaaaatagccttaactgatgacattccaccat

SEQ ID NO: 55 - DNA, 6143 bp, Homo sapiens
gtcaggcctctgagcccaagctaagccatcatatcctctgtgacctgcatgtatacatccagatggcctgaagtaactgaagaatcacaaaagaagtgaaaatggcctgttcctgccttaactgatgacattaccttgtgaaattccttctcctggctcatcctggctcaaaagctcccctgctgagcaccttgtgacccccactcctgccagccagagaacaaccccctttgactgtaattttcctttacctacccaaatcctataaaacagccccacccctatctcccttcactgactctcttttcagactcagcccacctgcacccaggtaaaataaatggccttgttgctcacacaaagcctgtttggtggtctcttcacacggacacaagtgaaatttggtgccctgactcggatcgggggacctcccttgggagctcaatcccctgtcctcctgctgtttgctctgtgagaaagatccatctacaaccttgggtcctcagaccaaccagcccaaggaacatctcaccaattttaaatcgggtaagcggcctctttttactctcttctctaacctctctgactatccctcaacctctttctcctttcaatcttggcgccatctttcaatctctgccttctcttaatttcagttcctttccttttctggtagagacaggagacgcattttatccatgaacccaaaactccggcaccactcatggactcaggacgacagtcttcccttggtgtttaatcacgcggggatgcctgcctgattattcacccacgtttcagaggtgtctgaccacatggggatgcctgccttggtccttcacccttagcggcaagcaccacttttctggggggcaagcaccccccgaccccttctctccatgtctctaccctctcttttctgccttggtccttcacccttagtggcaagcaccacttttctggagggcaagcacccccctactccttctctccatgtctctaccccttttccactttcctggggggcaagcaccccccaccccttctttccatgtctctagcctctcttttctctgggcttgcctccttcactatggacaaccttccaccctccattcctccctcttctcccttagcctgtgttctcaaaaacttaaaacctcttcaactcacacctgatctaaaacctaaatgccttattttcttctgcaacactacttggccccaatacaaacttgacaatggctctaaatggccagaaaatggcactttcaatttttccatcctacaagatctagataattcttgtcataaaatgggcaaacggtctgaggtgcctgacgtccaggcattcttttacacattggtccctccctagtctctgttcccaatgcaactcatcacaaatcttccttctttccctccgcctgtcccctcagtcccaatcccaagtgttgctgagtctttccaatcttcctttttttttttttttttttacagacccatctgacctctcccctcctccccaggctgctccttgccaggccgcgccaggttccaattcttcctcagcctccgctcctccaccctataatccttttatcaactcccctcctcacacctggtcccgcttacagtttcattccatgactagccctccccaacctgcccagcaatttcctcttaaaaaggtggctggagctgaaggcatagtcaaggttaatgctcctttttctttacccgacctctcccaaatcagttagcgtttaggctctttttcatcaaatatgaaaaacccagcccagttcttggcccctttagcagcaacccttagactctttacagccctagactcggaagggtcagaagtccatctcattctaaatatgcattttatcacccagccagctcctgacattaaataaaactccaaaaattaaataaattccagccctcaaaccccacaacaggacttaattaacctcactttcaaggtgtacaataatacagtagaggcagccaagtagcaatgtatttctgagttgcaattccttacctccactgtgagacaaaccccagccacatctctagcacacaggagctccaaacgcctgaaccgcagcttccaggggttcctccagaacctcctcccccaggagcttgcttcaagtgccagaaatctggtcactgggccaaggaatgcccgcagcctgggattcctcctaagctgtgtcccatctgtacgggaccccactggatatcagactctccaacttgcccagcagccactcccagagcccctggaactctggcccaaggctctctgactgactccttcccagatctgcttggcttagcggctgaagactgacgcagccccgtcacctcggaagccccctggaccatcacggacgccgagctttgggtaactcttacagtggaaggtaagtccatccccttcttaatcaatacagaggctacacactccacattaccttttcaagggcctgtttcccttgtctccataactgttgtgggtattgacaaccaggcttctaaacctcttaaaactccccaactctggtgccaacttggataacattctttaatgcactgctttttagttaatcccacctgcccagctcccttattaggtctaggcattttaactaaattatctgcttccctgactattcctgggctacagccacacctcattgccaccttttcccccagttcaaagcttccttcacatcctccccttgtatctccccaccttaccccacaagtataggacacctctactccctccttggcgaccaatcatgcaccacttaccatcccattaaaacctaatcacccttaccccactcaatgccaatatcccatcccacagcccactttaaaaggattaaagcctgttatcactcgcctgctacagcatgggcttctgaaacctgtatactctccatacaattcccctattttacatgtccaaaaaccggacaagtcttacaagttagttcaggatctgcgccttatcaatcaaattgttttgcctatccaccccgtggtgccaaacccatgtactctcctatcctcaatacctccctccacaacccattattctgttatggatctcaaacatgctttctttactattcctttgcacccttcatcccagcctctctttgctttcacttggactgaccctgacacccattaggctcagcaaattacctgggctgtactgccacaaggcttcacagataggctcagtcaagcccaaatttcttcctcatctgttacatatcttggcataattctcataaaaacacacgtgctctccctgctgatcatgtccgactaatctcccaaaccccaatcccttctacaaaacaacaactcctttccttcctaggcatggttagtgcagtcagaattcttacacaagagccaggactgtgccctgtagcctttttatccaaacaacttgaccttactgttttagcctagtcctcatgtctgtgtgcagcagctgccactgccttaatacttttagaggacctcaaaatcacaaactatgctcaactcactctctaaaattctcataacttccaaaatctattttcttcctcccacatgatgcatatactttcttctccccagctccttcagctatacttactcattgttgaatctcccacagttccattgttcctggcccagacttcaatccggcctcccacattattcctgataccacacctgacccccatgactgtatctctctgatccacctgacattcactccatttccccatatttccttctttcctgttcactattggtttattgataaaccctgaacactattggtttattgatggcagctccaccaggcctaatcgccacttaccagcaaaggcaggctatgctgtagtatcttccatacctatcattgaggctacctctctgcccccctccactacctctcaaaaagccaaactcattgccttaactcaagccctcgctcttacaaaaggactatgcatcaatatttatactgactctaaatatgccttccatatcctgcaccaccatgctgttatatgggcagaaagaaatttcctcactatgcaagggtcctctatcattaatgcctctttaataaaaactcttctcaaagctgctttacttccaaaggaagctggagtcactcactgcaagggccatcaaaagtcatcagattccatcactcaggacaatgcttatgctgataaggtagctaaaaaagcagctagcgttccaacttctatccctcacggcagtttttctccttctcatctggccactcccacctactctcccactgaaacttccacctatcgatctcttcctacacaaggcaaatggttcttggaccaaggaaaatatctccttccagcctcacaggcccattctattctgtcatcatttcataacctcttccatggaggttacaagctgctagcccacctcttagaacctctcatttcctttcaatcatggaaatctaaccttaaggaaatcacttctcagtgttccatctgctattctactactcctcagggattgttcaggcccccccacttccctacacatcaagctcggggatttgtccccacccaggactggcaaattgactttactcacatgcctcagtcaggaaactaaaatacctcttggtctgggtagacactttcactgggtgggtagaggcttttcccacagggtctgagaaggccactgcagtcatttcttcccttctgtcagacataattcctcagttggccttcccacctctatacagtctgataacagaccagcctttattagtcaaatcactcaagcagtttctcaggctgttggtattcagtgaaacctttatatcccttaccatcctcagtcttcaggaaaggtagaacagactaatggtcttttaaaaacacacctcatcaagctcagccaccaacttaaaaagtaccggacaatacttttaccacttgcccttatcagaattcaggcctgtcctcagaatgctacagggtacagcccatttgagctcctgtatagacgctcctttttattaggccccagtctcattccagacaccagaccaacttagactgtgccccgaaaaacttgtcatccctactatcttctgtctggtcacactcctattcactgttctcaactactcatacaagccctgctcttgtttatgctgccggtttacactgtttctccaagccatcacatctgatatctcctggtgctatctccaaactgccactcttaactcgctcttaaagtaaataaataatctttgctggcagggctatgctgaacctccttgggcactctctaattggatgtcctgggtcctcccaattcttagtcctttaatacctgtttttctcctcttattctgtttagtttttcaattcatacaaaaccgtatccaggccatcaccaataattctatatgacaaatgtttcttctaacaaccccacaatatcaccccttaccacaaaatcttccttcagcttaatctctcccactgtaggtccccacgctgccccaatcccactcaaagcagccctgagaaacatcgcccattatctctccagatcaccccccaaaattttcaccaccccaacacttcaacactattttgttttatttttcttattaatataagaagacaggaatgtcaggcctctgagcccaggctaagccatcatatcctctgtgacctgcatgtatacatccagatggcctgaagtaactgaagaatcacaaaagaagtgaaaatggtctgctcctgccttaactgatgacattaccttgtgaaattccttctcctggctcatcctggctcaaaagctcccccgctgagcaccttgtgacccccccccacccctgccagccagagaacaaccccctttgactgtaatcttcctttacctacccaaatcctataaaacagccccgcccctatctcccttcgctctcttctgattcagcccacctgcacccaggtgaaataaacagccttgttgctcacacaaagcctgtttagtggtctcttcacacggac

SEQ ID NO: 56 - DNA, 401 bp, Homo sapiens
gtcaggcctctgagcccaagctaagccatcatatcccctgtgacctgcatgtacatacgtccagatggcctgaagcaagtgaagaatcacaaaagaagtgaaaatggcctgttcctgccttaactgatgacattaccttgtgaaattccttctcctggctcatcctggctcaaaagctcccccactaagcaacttgtgacacccacctctgcccgccagagaacaaccccctttgactgtaattttcctttaccaacccaaatcctgtaaaatggtcccaaccctatctcccttcactgactgtcttttcggactcagccagcctgcacccaggtgattaaaaagctttattgctcacacaaagcctgtttggtggtctcttcacacagacacgagtgaaa

SEQ ID NO: 57 - DNA, 6271 bp, Homo sapiens
gtcaggcctctgagcccaagccaagccatcgcatcccctgtgacttgcacgtatatgcccagatggcctgaagtaactgaagaatcataaaagaagtgaatatgccctgccccaccttaactgatgacattccaccacaaaagaagtgtaaatggccgatccttgccttaaatgatggcattaccttgtgaaagtccttttcctggctcatcctggctcaaaaagcacccccactgaacaccttgcgacccccactcctgcccgccagagaacccccctttgactgtaattttcctttacctactcaaatcctataaaacggccccacccatatctcccttcgctaactctcttttcagactcagcccgcctgcacccaggtgaaataagcagccatgttgctcacacaaagcctgtttggtggtctcttcaaacggacgcacatgaaatttggtgctgtgactcggatggggggacctcccttgggagatcaatcccctgtcctcctgttctttgctccatgagaaagatccacctacaacctcaggtcctcagactgaccagcccaaggaacatctcaccaattttaaatcaggtaagcggcctcttcttattctcttctccaacctctctcatcactgtccctcaaccactttctcctttccactcttcaatctctcccttctcttaatttcaattcctttcattttctgggagagacaaaggcgacacgttttatccgtggacccaaaactctggcgccggtcacagactgggaaggcagccttcccttggtgtttaatcattgcagggacgcctctctgattattcacccacgtttcaaaggtgtcagaccacccagggatgcctgccttggtccttcacccttagtggcaagtcctgcttttctgggaaaggggcaagtaccccaatcccttctctccttgtctctaccccttctctgcttttctgcgggaggggcaagtacccctcaaccccttctccttcactcttagcggcaagtcctgcttttctagaggggcaattaccccaacctcgtatctctgcgccccaatcccttatttccatgccccaacctcttatatctctgcaccccaatcccttatttccatgccccgacctcttatctctgcgccccaatcccttatctctgtgccccaatcccttatttccgtgccccaaccccttatttctgtgccccgaccctttatttccgtgccctgaccccttatttccatgccccgaccccttatttctgcaccccatcccttatttctgtgccccatcccttatttccatgccccaacctcttatctctgcaccccaaccccttttcctacttttctggaaggtaagaacccccgaaccccttccctccatttctctactccctcttttctctaggcttgcttccttcactatgggcaaccttccaccctccattcctccttctactcccttggcctctgttctcaaaaacttaaaacctcttcaactcacacctgacctaaaacctaaatgccttattttcttctgcaatgccacttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacgtcagtcccttcctagtctctgtgcccagtgcaactcgtcccaaatcttccttctttccctcccgcctgtcccctcagtaccaaccccaagcatcactgagtctttctaatcttccttttctacagacccatctgacctctcccttcctccccaggctgctccttgccaggccgagctaggtcccaattcttcctcagcatctgctcctccaccctataatctttttatcacctcccctcctcacacctggtccagcttacagttttgttccctgactagccctccccatcctgcccagcaatttactcttaaaaaggtggctggagctaaaggcatagtcaaggttaatgctcctttttctttatcccaaatcagacagcatttaggcactttttcaacaaatataaaaatccagcccagctcatgacttgtttggcagcaaccctgagacgctttacagccctagaccctaaaaggtcaaaaggccgtcttattctcaaaatacattttattacccaatctgctcccgacattaaataaaactccaaaaattaaattccagccctcaaaccccacaacaggatttaattaacctcgccttcaaggtgaacaataatagaaaaaagttgcaattccttgcctccactgtgagacaaaccccagccacatctccagcacacaagaacttccaaacgcctgaactgcagcagccaggcattcctccagaacctcctcccacaggagcttgctacatgtgccagatatttggccactgggccaaggaatgcccgcagcccaggattcctcctaagccacgtcccatctgtgtgggaccccactgaaaatcggactgttcaactcacctggcagccactcccagagcccctggaactctggcccaaggctctctgtctgactccttcccagatcttctcggcttagcggctgaagactgacactgcccgatcgccttggaagccccctagaccatcacggacgccaagcttcgggtaactctcacaatggaaggtaagccccgtccccttcttaatcagtacagaggctacccactccacattaccttcttttcaagggcctgtttcccttgcctccataactgttgtgggtattgacagccaggcttctaaacctcttaaaactccccaactctggtgccaacttagacagtactcttttaagcactcctttttagttatccccacctgcccagttcccttattaggctgagacactttaactaaattatctgcttccctgactattcctggactacagctatatctcatcgccacccttcttcccaatccaaagcctcctttgcatcctcctcttgtatccccccaccttaattcacaagtataagatacctctactccctccttggcatgatcatgcaccccttaccatctcattaaaacctaatcacccttaccccactcaacgccaatatcccatcctgcagcatgctttaaaaagattaaagcctgttatcactagcctgctacagcatggcctttataaagcctataaactctccttacaattcccccattttacctgtcctaaaaccagacaagccttacaagttagttcaggatctgtgcctaatcaaccaaattgttttgcctatccaccctgtggtgccaaacccatatactctcctatcctcaatacctgcctctacaacccattattctgttctagatctcaaatatgctttctttactattcctttgcacccttaatcccagcctctcttcactttcacttggactgaccctgacagccaacaagctcagcaaattacctaggctgcactgccacaaagcttcacagatagcccccattacttcaatcaagcccaaatttcttcctcatctgttacctatcttggcataattctcataaaaacacacgtgctctccctgccaattgcatccgactgatctctcaaaccccagcaccttctacaaaacaacaactcctttccttcctaggcatggttagtgtggtcagaattcttacacaagagccaggaccacaccctgtagcctttctgtccaaacaacttgaccttactgttttttgttttttgtttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccgaccttactgttttagcctagccctcatgtctgcatgcagtggctgccactgcattaatacttttagaggccctcaaaatcacaaactatgctcaactcactctctacagttctcataacttccaaaatctattttcttcctcatacctgacgcatatactttctgcttcctggctccttcagctatactcactctttgttgagtctcccacaattactgttgttcctggcccagacttcaatccagcctcccacattattcctgataccacacctgacccccatgactgtatctctctgatccaccttacattcaccccatttccccaaatttgcttctttcctgttcctcaccctgatcatgcttgatttattgatggcggttccaccaggcctaatcaccacacaccagcaaaggcaggttatgctatatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcaaggatttgccccacccaggactggcaaattagctttactcaacatgccctgagtcaggtaactaaaataccttttaatctaggtagatactttcactggataggtagaggcctttcctacagggtctgagatggccaccgcagtcatttcttccgttctgtcagacataattccccagtttagccttcccacctcaatacagtctgataacaggtgagcctttattagtcaaatcagccaagcagtttttcaggctcttagtattctgtgaaacctttatatcccttaaggtcctccatcttcaagaaaagtagaatggactaaaggtcttttaaaaatacacctcaccaagctcagccaccaacttaaaaaggactggacaatacttttaccactttcccttctcagaattcaggcctgtcctcggaatgctacagggtacagcccatttaagctcctgtatagatgctcctttttattaggccccagtctcattccagacaccagaccaacttagactgtgccccaaaaaacttgtcatccctactatcttctgtctagtcatactcctattcaccgttctcaactactcatacacgccctgctcttgtttacactgccggtttacactgtttttccaagccatcacagctgatatctcctggtgctatccccaaactgccactcttaactcttgaagtaaataaataatctttgagggcaggactatgctgaatctccttaggcactctctaatcagatatcctgagtcgtcccaattcttagaccttttatacctgtttttctccttctgttattccatttaatttctcaattcatccaaaaccgtatccaggccatcaccaatcattctataagacaaatgtttcttctaatatccccacaatatcaccccttaccacaagacctcccttcagcttaatctctcccactctaggttcccacaccgcccctaatcctgcttgaagcaaccctgagaaacatcgcccattctctctccataccaccccccaaaaattttcgccaccccaacacttcaacactattttgttttatttttcttattaatataagaaggcagaaatgtcaggcctctgagcccaagccaagccatcgcatcccctgtgacttgcacgtatatgcccagatggcctgaagtaactgaagaatcataaaagaagtgaatatgccctgccccaccttaactgatgacattccaccacaaaaaaagtgtaaatggccgatccttgccttaagtgatgacattaccttgtgaaagtccttttcctggctcatcctggctcaaaaagcacccccactgaacaccttgcgacccccactcctgcccgccagagaacccccctttgactgtaattttcctttacctacccaaatcctataaaatggccccacccctatctcccttcgctgactctcttttcggactcaccccgcctgcacccaggtgaaataaacagccatgttgctcacacaaagcctgtttggtggtctcttcacatggacacgcatgaaa

SEQ ID NO: 58 - DNA, 58 bp, Homo sapiens
tgcctgtatatgccggcagccccctagcccgctctttcactggatatctgtgtctgag

SEQ ID NO: 59 - DNA, 410 bp, Homo sapiens
gtcaggcctctgagcccaagctaagccatcatatcccctgtgacctgcatgtgcacatccagacggctggttcctaccttaactgatgatattccaccacaaaagaagtgaaaatggctggtccctgccttaactgatgacattaccttgtgaaattccttctcctggctcatcctggctcaaaagctcccccactgaacaccttgcaacccccacccctggccaccagagaacaaccccctttgactgtaattttccattacctacccacatcttataaaatggccccatccctatctcccttcgctgactcttttcggactcagcccgcctgcacccaggtgaaataaacagccttgttgctcacacaaagcctgtttggtggtcgcttcacacagacacgagtgaaa

SEQ ID NO: 60 - DNA, 5820 bp, Homo sapiens
gcagggaaaagaaagagagatcagacggttactgtgtctatgtagaaaaggaagacataagaaacatcattttgatctgtaccctgactttgccctgagatgctgttaatctgtaactttagccccaactttgagctcacagcagcatgtgttgtatagaatcaaggtttaaggggtccagggctgtgcaggatgtgctttgctagcaaaaggtttacaggcagtatgcttgataaaagtcatcaccattctccattctcaagtaaccaggggtgcaatacactgtgaaaaacttcagggacccctgccctggaaagccaggtattgtccaaggtttctcctcatgtgatagtctgaaatatgacctcattgaatgggaaagacctgaccttccacccagcttgacacccattaagggtctgtgctgaggaggattagtaaaggaggaaggcctcttgcagttaagaggaaggcttctgtctcctgcctgcccctgggaactgaatgcctcagtataaaacctgattatacatttgttctattctgagataggagaaaaactgcctgtggtgggaggcgagacatgttggcagcaatgctgctttgttactctttactccactgagatgtttgggtggagaaaagcataaatctggcctatgtgcacatccaggcatagtaccatcccttaaacttatttgtgacacagattcctctgctcacatgttttcttgctgattttctccccactatcaccctgctctcctgccacttttcccttactgagttagtgaaaatagtaatcaataaatactgagggaactcagagaccagtggcggtgtgggtcctccgcatgctgagcaccagtcccctgggcccatttttctttctctatactttgtctctgtgtcttatttcttttctcagtctcttgtcctgcctgatgagaaatacccacaggtgtggagtggctgacccccttcatatggcgcccaacatgggcctttctctagggtgaaggtacactaaaaacgtgagcattgaagacagtcaacgagagattcccaagtacttccatggtcagccatgcggtaagcttgtgcgctcagtggaactcagggtaacaatgggacaaactgaaggtaaatatgcctcttatctcagcttcattaaaattcttctaagaagatggggagttagagcttctacagaaaatctaattatgttatttcaaacaatagaacaattctgcccatggtttccaaaacagggaactttagatctaaaagattgggggaaaattggcaaagaattaaaacaagcaaatagggaaggtaaaatcatcccacttacagtatggaatgattggcccattattaaagcaactttagaaccgtttcaaatagaaaaagacagcctttcaatttctgatgcccctgaaagatgtgtagtagattgtgaagaagaggcagagacaaaatcccggaaattaatggaaagttcacattgtaaaaatgtagcagagtctgtaatggctcagtcaacgcaaaatgttgactacaatcagttacaggaggtagtatatcctgaatcatcaaaactggtggaaggaggtccagaattattggggctaccagagcctaaaccaccatggccatcaactcctcctccagtggttcagatgcctgtaacattacaacctcaaatgcaggttagacaagtgcaaaccccaagagaatatcaagtagaaaaggatagagtctctatcccagcaatgccaattcagatacagtatccacaatatcagctggtagaaaataagacccaaccaccggtagtttatcaatactggccgccagctgagcttcagtatgggctgtctccggaggttcaatacagacctcaagctgtgtgtcccgtgccacatagcacggcacctcaccagcaacccagtggtgtttaatcctacatcaccacctagtggacaaggtagtacactgcatgaaatcattgataaagccagaaaacagggagatcgtgaggcatggcagttccttgtaattttacaaccaataccagctgggaaaggggggcaagctggagcgtctgtccaaactgaggctagatatgaatctttcaccatgaaaatgttaaaagatatgaaggaaggagttaaacaatatggacccaactccccttatatgagaactttattagattccattgctcatggaaatagacttattccctatgattgggaaacgttggctaaatcttccctttcaccctctcagttcctacaatttaaaacctggtggattgatggagtacaagaacaggcatgaaaaaatcaggctatttatcccgctgttaatatagatgcagatcaattgctaggaacaggtccaaattggagcacaattggccaacaatcagtaatgcagaatgagggtattgaacatctaaaggctctttgcctcagggactgggaaaaaattcaggacccaggcacctgggtgccccacgcaccgcttgcccaggcatcgcttgcccaggcactgcttgcccttcttctaattcaattagacaaggctgtaaagagccatatccagacttcgtggcaaggttgcaagatgcctctgaaaaatctgtttcagatgataatgcccaaaaagttattgtagaaataatggcttttcaaaagtcaaatccagaatttcaaccagccataaagccattaaaaggaaaaggtccagcaggagttgatgtaattacagaatatgtgaaagcttgtgatgggattggaggagctatgcgtaaggcaatgctaatggctcaagcaatgaccggagtcactttaggaggatagttagagcatttggggggaaatgttataattgtggtcaaatcggtcatctaaaaaagaactgcccagtcttaaataaacagagtaaaaataaagagccacctggcctgtgtccaagacatggaaaaggaaaacattgggctaatcaatgtcgttctaaatatgataaaaatgggcaactattgtcagaaaaaggggtgaggggccagcctcagtcccaacaacaaactggggcattcccgattcagccgtttgttcttcagggttttcagggacagcaacccccacagcaaataccaccacttcagggaatcagccaattacaacaatacaacagctgtcccccgccacagcaggcagcacagcagtagatttatgttccactcaaaaggtttctttactccctggagagaccccgcaaaagattcctacaggggtatatggcccactgccaggagggacagtaggcctcattttagggagatgaagtctaaatttgaagggagtccaaattcatactggggtaattgattcagattataaaggggaaattcagttagtgatcagctccactgttccctggagtgccaatccaggtaatagaattgctcaattattgcttttgccttatattaaaattgggaaaacaaaacggaaaggacaggagggtttggaagtaccaactctgccagaaaagccactcaatgggctcgtcatgtctcagagaatagacctgtgtgtacagtcactattcagggaaagcagtttataggattattggataccgatgctgatgtttcccttatcgccttaaatcaatggccaaaaaattggcctaaacaaaagcctgttacaggacttgtcggtgtgggcagcgcctcaaaagtgtatcaaagcaccatgattttacattgtctaggacctgataatcaagaaagtacagttcaacctatgattacttttattccaaataattttttgggccgagacttgttacaacaatgacatgcagagattactatcccagcctccttatacagccccacgagtcaaaaaatcatgactaaaatgagatgtctccctggcaaaggactagggaaaaatggagatggcattaaaatcccaattgaggctgagggaaatcaagaaagaaaaagaataggatatcctttttaggagtggccactgtagagcctccaaaacccattccattaacttggaaaacagaaaaacctgtatgggtaaatcagtggctgctaccaaaacaaaagctggaggctttacacttacgggcaaaagaacaattagcaaagggacatattgagccttcattttcgccttgaattctcctgtgtttgtaactcagaaaaaatccggcagatggcacatgttgaccgacttaagagccgtcaatgctgtaattcaacctatgggggctctccaacctgggttgccctctctggccatgatccccaaagattggcctttaattataattgatctgaaggattgcttttttaccattcctctagcaaaacaggattttgaaaaatttgcttttactataccagccataaataataaagaaccagccaccaggtttcagtggaaagtgttgcccagggaatgcttaatagtccaactatttgtcagatttttgtagctgaagctcttcaaccagttagagacaagttttcagactacgtctttcattatgttgatgatcttttgtgtgctgcagaaacgagagacacattaattgactgttacacatttctgcagacagaggttgcaaacgcaggactgacaatagcatctgataagattcaaacctctactcctgtccattacttgggaatgcaggtagaggaaagaaaatttaaacaacaaaaaatagaaataagaaaagacacattaaaaacattaaacgactttcataaattgctaggagatattaattggatttggccaactctaggcatccttacttatgccatgtcaaatttgttctctatcttgagtggggatccagaattgaatagtaaaagaacattaactccagaagcaactaaagaaattgaattaattgaagaaaaaattcggtcagcacaagtaaatagaatagatcacttcgccccactccaacttttgatttttgctactgcacattctcaacaggcattattgttcaaaatacagatcttgtggagtgatctttccttcctcacagtacgattaagacttttacattgtacttggatcaaatggctacattaattggtcaggcaagattacaaataataaaattgtgtggaagtgacccagataaaatcattgttcctttaaacaaggaagagtttagacaaggctttatcaattctgctgcatggcagattggtcttgctgattttgtgagaattactgataagcattacccaaaaacaaaaatcttccagtttttaaaattgactacttgaattttacctaaaattaccagacataaacctttagaaaatgctctgatggtgtttactgatggttccagcaatggaaaagtggttcacaccaggccgaaagaacgagtcattgaaaatcagattctgcatatgtagcacagctacaaagtatgttgagacagccctaatcaaatatagtatggatgatcagttaaacaagccctttaatttgttacaacaaattgtaagaaaaagaaatttcccattttatattactcatatctgagcacgtactaatttaccaaggcctttaactaaagcaaatgaacaagctgacttgctagcatcatctgcattcatagaagcacaagaacttcatgctttgactcatgtaaatgcaacaggactaaaaaataaatttgatatcacatggaaagaggcaaaaaatattgtataacattgcacccagtgtcaagtcctacacctgcccactcagg

SEQ ID NO: 61 - DNA, 981 bp, Homo sapiens
gtagagaaaagaaagagatcagactgttactgtgtctatgtagaaagggaagacataagaaactccattttgacctgtaccctgaacaagtgctttgccctgagatgctgttaatctgtaactttgccccaaccttgagctcacagaaacatgtgttgtatggaatcaaggtttaagggatctagggctgtgcaagatgtgccttgttaacaaaatgtttacaggcagtatgcttggtaaaagtcatcgccattctccagtctcgataaaccaggggcacaatgcactgcagaaagccgcagggacctctgcccaggaaagctgggtattgtccaaggtttctccccatgtgatagtctgaaatatggcctcgtgggatgggaaagacctgaccgtcccccagcccgtcacccgtgaagggtctgtgctgaggaggattagtaaaagaggaaggcctcttgcagttgagatagaggaaggccactgtctcctgtctgctcctgggaactgaatgtctcggtataaaacccaattgtacatttgttcaattctgagataggagaaaagcctccgtgtggcgggaggcgagacatgttggcagcaatgctgctctgttactctttactccactgagatgtttgggtggaaaaaagcataaatctggcctacatgcacatccaggcatagtaccttcccttgaacttatttgtggcacagattcctttgctcatgtgttttcttgttgacctcctccccattatcaccctgctctcctgcctcattcctcttgctgagacagtgaaaatagtagttaataaatactgagggaactcagagactggtgccagtgcaggtcctccgaatgctgagcgccggtcccctgcgcccacttttctttctctatactttgtctctgtgtcttatttcttttctcagtctcttgtcctgcctgatgagaaatacccacaggtgtggaggggc

SEQ ID NO: 62 - DNA, 3495 bp, Homo sapiens
gactgactccttcccagatctccttggcttagcagctgaagactgatgctgcccatcgccttggaagccccctggactatcatggatgctgagcttcaggtaactcttacagagaagagtaagtccgtcccctgtttaatcgatacgggggctacccactccacattaccttcttttcaagggcctgtttcccttgcccccataactgttgtgggtattgatggccaagcttcaaaaccccttaaaactcccccagtctggtgccatcttggacaacattcttttatgcactcttttttatccccacctgcccagttcccttattagactgagacattttaaccgaattatctgcttccctgattattcctggactgcagccacatctcattgccacccttcttcccaacccaaagcctccttcgtgtcttcctctcatatcctcctaccttaacccgcaagtatgggacatctccactccctccctggcaaccgatcacacgcccattactatcccattgaaacctaatcacccttaccccacacaatgccagtatcccatcccacaacaggctttaaggggattaaagcctgttatcacttgcctgctacagcatgggcttctaaaacctataaactctccttacaattctgccattttacctattcaaaaaccggacaactcttacaggttagttcaatatctgtgccttatcaaccaaattgttttgcctatccaccctgtggtgcccaacccatacactcttttgtcctcaatatcttcctccacaactcactattccattcttgatcttaaagatgctttttgcactattcccctacacccctcgtcccagcctctctttgcttttacctggcctgacgctgacacccatcagtcccagtagcttacctgggctgtactgccgcaaggcttcagggacagccctcattacttcagccaagctctttctcatgatttactttctttccacccctccacttctcaccttattcaatatactgatgaccttctactttgtagcccctcctttcaatcttctcaacaggacaccctcctgctccttcaacactaattctccaagggatatggggtatccccctccaaagctcaaatttcttctccatccgttacctacctcggcataattcttcataaaaacacacgtgctctccctgccgatagtgtctgactgatctctcaaaccccaaccccttctacaaaacaacaactcctttccttcctgggcatggttggatacttttgcctttggatacctggttttgccatcctaacaaaaccaatacataaactcacaaaaggaaacctagctgaccctatagatcctaaatcctttccccactcctctttctgttccttgaagacagctgtagagactgctcccacaatagctttccctgactcatcctaactgttttcattacatacagctgaattgcagggctgtgcatttggaattcttacacaaggaccaggaccgcactctgtagcctttttaaccaaacaattgaccttactgttttaggctggccatcatgtctccgtgcagcggccgccattgccctaatactttcagaggccctcaaaatcacaaactatgctcaactcactctctacagttctcataacttccaaaatctattttctgcctcacacatgacacatatactttctgctccctggctccttcagttgtactcactctttgttgagtctcccacagttaccattgttcctgacccagacttcaatccggcctcccacattattcccgaaaccacacctgacccccatgactgtatctctgatacacctgacattcactccatttccccatatttccttctttcctgttcctcaatctgatcacacttggtttactgatgatagttctaccaggcctaatcgccactcaccagcaaaggcaggctatgctatagtatcttccacatctatcactgaggctaccattctgcccccttccactacctctcagcaagccaaactcattgccttaactcaggccttcactcttgcaaagggactatgtgtcaatatttatactgactctaaatatgccttccatatcctgcaccaccatgctgttatataggctgaaaaaggtttcctcactacacaagggtcctccaacattaatgcctctttaataaaaactcttctcaaggccgctttacttccaaaggaagctggagtcatacactgcaagggccatcaaaaggcatcagatcccatcactcagggcaacgcttatgctgataaggtagctaaagaagcagctagcattccaacttctgtccctcacggccagttttcctccttctcatcagtcactcccacctactctcccaccgaaacctccacctatcaatctcttcccacacaaggcaaatggttcttggaccaaggaaaatatctccttccagcctcacaggcccattctattctatcgtcatttcataacctcttccatgtaggttacaagccactagcccgcctcttagaacctctcatttcctttccattgtggaggtctatccctaaggaaatcacttctcagtgttccatctgctattctactactcctcagggattgttcaggccccctcccttccctacacgtcaaactcggggatttgcccctgcccaggaccagcaaattgactttactcacatggctcgagtcaggaaactaaaatacctcttggtctcggtagatgctttcactggatgggtagaggcctttcccatagggtctgagaaggtcactgcggtcatttcttcccttttgtcagacgtaattcctcggttttgccttcccacctctatacagtccaataacggactggccatgattagtcaaatcacccaagcagtttctcaggctcttggtattcagtggaaactttgtaccccttaccatcctcaatcttcaggaaaggtaaaatgggctaatggtcttttaaagacacacctcaccaagctcagcctccaacttaaaaaggactggacagtacttttacctcttgcccttctcagaattagatcctgtcctcgagatgctacagagtacagcccatttaagctcctgcatggacactcctttttattaggctccagtctcattccagacaccagcccaacttgaagtgtaccccaaaaacttggatagagccttgaaagtcgccaaccaagcaaacaataacattgaacccccttggacgctctctaattggacgtcctgggtactcccaattcttagtcctttaacacctatttttctccttcttttattcggaccttgtgtctttcatttagtttctcaattcatacaaaaccgcattcaggccaacaccaataattcgatatgacaaacgctccttctaacaaccccacaatatcaccccttaccccaaaatctttcttcagttgaa

SEQ ID NO: 63 - DNA, 5287 bp, Homo sapiens
gtcaggcctgagcccaagctaagtgatcatatcccctgcgacctgcacatatatatccagatggcctgaagcaactgaagaaccacaaaagaagtgaaaatagccagttcctgccttaactgatggcattccaccactgtgatttgttcctgccccaccctaactgaccaattgaccttgtgacattccttctccggggcaatgaatctcaggagctccccaccaagcatcttgtgacccccactcctgcccacaagagaacaaccccctttaactgtaattttccactacctacccaaatcctataaaactgtcccaccccatctctctccctttgctgactcctttttcagattcgcccacctacgcccaggtgattaaaaagctttattgctcacacaaagactgtttggtggtctcttcacacggacgcatgtaacatttggtgctgaagacctgggacagggggattccttcaggagactggtcccctgtcctcgccctcactccttgaggagatccacctacgaccttgggtcctgaaatcagcccaaggaacatctcaccaatttcaaatcaggtaagtggtctcttcactctcttctccagcctctctcactacccttcagtctccctgtgcttccaattccagctctttttcctctctagcagagacaaaggagacacattttatccgtgaactcaaaaactccaacgtcggtcacaaatttaggaagacagtcttcccttggtgtctgatcactgcagggatgcctgccttgatcattcacccacattccattggtgtctgatcactgcggggatgcctgccttggtcatttacccacatttccttggtggtaagtcaactgtggggatgcctgctttggctgctcacccatattacagcccagggctgctcacccctgccctccaccctgtgtctctacctttctctttagacttacctccttcactatgggcaactttctgccctccattcccccttcttctcccttagcctgtgttcttaaaaacctaaaaccccttcaactaacacctgacctaaaacctaaacatcttattttcttctgtaataccacttggccccaatacaaactcgaaaatagttccaagtggccagagaatggcactttcgatttgtctatcctacaagacctagataatttttgtcgaaaattgggcaaatggtctgaggtgcctgacgtctaagcattctttacacattggtccctccctagtctctgctcccaatatgactcgtcccaaatctttcttctttctctcctgtctgttccttcaggctccaccccaagctctgagccctttgaatcctccttttctacagacccatctgacctttccccattccccaggctgctcctcgccaggccaagccagatctcaattcttcctcagcctctgctcctccaccctataatccttctatcacctcccctcctcacacccggtccggcttacagtttcgttccgtggctagccctcccctacctgcccaacaatttcctcttacagaggtggctggagctgaaggcatagtcaaggttaatgctcctttttctttatccgacctctcccaaatcagttagcgtttaggctctttttcatcaaatataaaaacccagcccagtccatggcctgtttggcaacaacccttagacactttaccaccctagatccagaggggccagaaggccgtcttattcttaatatgcattttattatccaatccactcctgacattagaaaaagctccaaaaattagattccggccctcaaaccccacaacaggacttaattaaccttgccttcaaggtgtacaataatagagaagaggcagccgagcggcagtgtatttctcaattgcaattacttgcctccactgtgagagaaaccccagccacatctccagcacataagaacttcaaaacgcctaaaccatagcagtcaggcattcctcctggactttttcccccaggatcttgctccaagtgctggaaatctggccagtgggccaaggaatgcccacagcctgggattcctcctaagccatgtcccatctgtgcaggaccccactggaaatcagactgtccaacttgcccagcagccattcctagagcccctggaactctggcccaaggctctctgactgactccttcccagatcttctcggcttatcagctgaggactgacgctgcccaatcgcctcgcaagcctcctggaccatcacagacacttcaggtaactgctacagtggagggtaagtccatccctttcttaattgataaggaggctacccactccacattaccttcttttcaagggcctgtttcccttgcctccataactgttgtgggtattgacggccaggcttctaaacctcttaaaactcccccactctggtgccaacttggacaacattcttttatgcactcttttttagttatccccacctgcccagttcccttattaggccgagtcattttaaccaaattatctacttccctgactattcctgggctacagccacatctcattgctgcacttttacccaactcaaggcctcttttacatcctccccttgtatctccctaccttaatccataattatgggatacctctactccctccttggtgaccaatcatgcataccttatcatcctgttaaaacctaatcacccttaccccactcaatgccaatatcccatcccatggcatgctttaaaagggttacaactcccctatcctacctgtccaaaaactggacaagtcttgcaggttggttcaggatctttaccttattaatcaaatcatccttcccatctatcctatagtgccaaacccatatactctcctatcctcaatacctccctccacaacccattattctgttctggatctccaagatgctttctttaccattcctttacacccttcatcccagcctctcttcgctttcacttggactaaccctgacacccatcagtctcagcaacttacctgggctgtactgctgcaaggcttcagggacagccctcattacttcagccaagctctttctcatgatttaatttatttccacccatgtgcttctcaccttattcaatatattgatgaccttctactttgtagcccctcctttgaatcttctcaacaagacacactccagctccttcaacatttattctccaagagatattgggtatccccctccaaagctcaaatttcttctccacccgttacctacttcagcataattcttcatgaaaacacatgtgctctccctgccgatcatgtccggctaatctctcaaaccccaaccccttctacaaagcaacaactcctttccttcctgggcgtggttggatactttcgcctttggatacctggttttgccatcctaacaaaaccattatataaactcacaaagggaaacctagctgaccccatagatcctaaatcctttccccactcctctttccattccttgaaaacagctctagagactgctcccacactagctctccctgactcatcccaacttttttcattacacacagctgaagtgcagggctgtgcagtcagaattcttacacaaggaccaggactgagccctgtagcctttttgtccaaacaacttgaccttactgttttaggctggccctcatgtttgcatgcggcggctgctgctgctctaatacttttagagaccctcaaaatcacaagctatgttccacttactctctacagttcccataactttcaaaatctattttcctcctaatgttggatgcctataccgcccccccggctccttcagctgtactcactatttgttgaatctcccacaattaccattgttcctgggccagacttcaatccagcctctcatcttattcctgatactacatctgagtcccatgactgtatctctctaatccacatggcattctccccatttccccatatttccctctttcctgttccccacctaggccacacttggtttattgatggtagttcctccaggcccagtcaccaatcaccagtaaaggcaggctatgctatagtgtcttccacatctatcattgagtctatggccctgcccgcttccactacctctcaacaagctgaactcattgccttaacttgagctgtcattcttgcaaagggactacgtgtcaatatctatacagattccaagtatgccttccacatccttcaccaccatgctgttatatgggcagaaagaggtttcctcactacacaagggtcctccattattaatgcctccttaataaataaactcttcttaaagctgctctacttccaaggaagctggggtcattcactgcaaggggcatcaaagggcatcagatcccatcactaaggacaatgcttatgctgataaggtacctaaagaagcagctagcaaacagcttcctgttcccctcatgacaccaacacttcactactattttgttttgtttttcttattattaatataagaagacaggaataggcctcgacttactgctaaaaaaggaggactctgtatatttttaaatgaagagtgttgtttttacctaaatcagtctggcctggtatatgacaacataaaaaactcaaggatagagcccaaaaactcgccaaccaagaaaataattacgctaaatccccttgggtactctctaattggatgtcctgggtcctcccagttcttagtcctttaatacctgtttttctccttctcttatttggacttgtgtcttctgtttagtttctcaattcgtacaaaactgcatccaggccatcaccaatcattctatatgacaaatgctccaacaaccccacaatatcaccccttaccccaaaatctttcttcagtttaatctttcccactctaggttcccacactgccccaatctcactcaaagcaaccctgagaaacattgccattatctctccatatcaccccccaaaattttcgccgccccaacacttcaccaccattttgttttgtttttcttattaatataagaagacaggaatgtcaggcctctgaacccaagctaagccatcatatctcctgtgacctgcacgtatacatccagatggcctgaagcaactgaagaaccacaaaagaagtgaaaatagccagttcctgccttaactgatgacacttcaccactgtgatttattcctgccccatcctaactgatcttgtgacattccttctcctgg

SEQ ID NO: 64 - DNA, 964 bp, Homo sapiens
gtggggaaaagagagatcagactgttactgtgtctatgtagaaagaagtagacataagagactccattttgttctgtactaagaaaaattcttctgccttgagatactgttaatctgtaaccctacccccaaccctgtgctcgcaaaaacatgtgctgtgtggactcaaggcttaatggatttagggctatgcaggatgtgctttgttaaacaaatgcttgaaggcagcatgcttgttaaaagtcatcaccactccctactctcaagtacccaggaacacaaaacacagcggaaggccgcagggacctctgcctaggaaagccaggtattgtccaaggtttctccccatgtgatagtctgaaacatggcctcgtgggaagggaaagacctgaccgtaccccagcccgacacctgtaaagggtctgtgctgaggaggattagtgaaagaggaaggcctctttgcagttgagataagaggaaggcatctgtctcctgcttgtcgactgggcaatggaatgtctccatgtaaaacccgattgtatattccatctactgagataggagaaaaccgccttagggctggagttgagacatgctggaggcaatactgctctttaaggcactgagatgtttatgtatatgcacctcaaaagcacagcatttttttctttaccttgtttatgatgcagagacatttgttcacttgttttcctgctgaccctctctccattactaccctattgtcctgccacattcccctctctgagaaacgcccgataatgatcaataaatactgagggaactcagagactgggccggcgtgggtcctccatatgctgagcaccggtcccctgggcctgcttttctttctctatactttgtgtctgtctctttcttttctcaagtctctctttccacctgacgagaaacgcccacaggtgtggaggggcaggccaccccttca

SEQ ID NO: 65 - DNA, 5941 bp, Homo sapiens
gtcaggcctctgagcccaagctaagctatcatatcccctgtgacctacacgtatacatccagctggcctgaaggaagtgaagaatcacaaaagaagtgaaaatggtcggttcctgccttaaatgatgacattccaccattgtgatttgtttctgccccatcttaactgagcgattaaccttgtgaaattctttctcctggctcagaagctccccgactgagcaccttgtgacacacgcccctgcccataagacaaaaccccctttgactgtaattttccactacccacccaaatcctatgaaacagtcccacccctctatctcctttcgctgactctttttggactcagcccacctgcacccaggtgattaaaaagctttattgctcacacaaaccctgtttggtggtctcttcacacagacacacgtgacatttggtgccgaagacccaggacaggaggactccttcaggagaccggtcccctgtgcttgccctcacttccgtgaggagatctgcctacaaccttgggtcctcagaccaaccagcccaaggaacatctcaccaatttcaaatcgggtaggcagtcttttcactctcttttccagcctctcttgctacccttcaatctccctgtccttccaattccagttatttttcctctctagtagagacaaagaagacacattttatccgtggacccaaaactccggcgccagtcacagactcgggaagatagtcttcccttggtgtttaatcgctgcggggacgcctgcctgattattcacccacactccattggtgtctgatcaccgtggggatgcctgccttggtcattcacccacattcccttggtggcaagtcaattgcggggatgcctgctttggctgctcacccacattgcagcccagggctgctcactacccccaccccttctccgtgtctctaccctctcttttctctgggcttgcctccttcactatgggcaaccttccaccctccattcccccttctgctcccttagcctgtcttctcaaaaacttaaaacctcttcacctctcacctgacctaaaacctaagcatcttattttcttgtgtaacaccgcttggccccaatacaaacttgataatggttctaaatagccagaaaacagcacttttgatttctccattttacaagacccggatgatttttgttgaaaaatgggcaaatgggtctgaggtgcctgacttccaggcattcttctacacattggtccctccctagtctctgctcccaatgtgactcatcccaaatctgtcttctttctctcctgtctgttccttcagtctccaccccaagctctgagtccttgaatcctccttttctacagacccatctgacctctcccctcctccccaaggctgctcctcaccaggccaagccaggtcccaattcttcttcagcctccactatcccaccctataatccttttatcacctcgcctcctcacacctggtctggcttacagtttcattccacgactagcccttcccgacctgcccaacaatttcctcttaaagaggtggctggagctaaaggcacagtcaaggttaatgctcctttttctttatccgacctctcccaaatcagttagtgtttaggctctttttcatcaaatataaaactcaacccagttcatggcccatttggcaacaacccttagatgctttaccaccctagacccagaagggccagaaggccgtcttattctcagtatgcattttattacccaatccactcccgacattaaataaagctccaaaaattagattccggccctcaaaccccataacaggacttaactaacctcaccttcaagatgtacaataatagagtagaggcagccaagtagcaacatatttctgagttgcaattccttgcctccaccgtgagagaaaccccagccacatctccagcacacaagaacttcaaaatgcctaagccacagtggtcaagcattccttcaggacctcctcccccaggatcttacttcagtgctggaaatctggccactgggccaaggaatgcccacagcctgggatacctcctaagccgtgtcccatctatgcgggaccccactggaaatcagactgtccaactcgcccagcagccactcccagagcccctggaactctggcccaaggctctctgactgactccttcccagatcttcttggcttagcggctgaagactgacgctgcaccatcacctcagaagcctcctggaccatcacagatgcttttggcaactcttacagtggaaggtaagtctgcccccttcttaatcaatacagaggatacccactccacattaccttcttttcaagggcctgtttcccttgcctccataactgttgtgggtattgaaggccaggcttcaaaaccccttaaaactcccccaactctggtgccaacttggacaacattcttttatgcactcctttttagttatccccacctgcccagttcccttattaggtcaagacattttaactaaattatctgcttgcctgactattcctaggttacagccacactctcattctgcccttttccctagttcaaagcctccttcgcatctccccttgtatctccccaccttaatccacaagtataggacatctctactccccccttggcgaccaatcatgcaccccttaccatcccattaaaacctaatcacccttacactgctcaatgccaatattccatcccacagcacactttaaaaggattaaagcctgttatcacttgcctattacagcatggccttttaaagcctgtaaactctccttacaattcccctattttacctgtccaaaaaccagacaagccttacaggttagctcaggatctgcgacttatcaaccaaattgttttgcctatccaccccacagtgccaaacctatatactctcctatcctcaatacctccctccacaacccattattctattctagataaacctagttgaccccatagatcctaaatcctttccccactctcctttccattccttaaaaaacagctcccacactagctctccctaacttatcactcccttttcattacacacagccaaagtgcagggctgtatggttggagttctcacacaagagacgggaccgtgttctgcagcctttctgtccaaacaacttgatcttactgttttagcctagccttcatgtctgtgtgtggcagctgccgcgctttaatacttttagaggccctcaaaatcacaaactatgctcaactcactctctacagttctcataacttccaaaatctattttcttcctcacacctgacgcatatactttctgcccccctccactacctctcagcaagccgaactcattgccttaactcaagccctcaatcttgcaaaaggactacgcatcaatatttatactgactctaaatatgccttccatatcctgcacctccatgctgttatataataggcaaaaagaggtttcctcactatgcaagggtcctccatcattaatgcctctttaataaaaactcttctcaaggccactttacttccaaaggaagctggagtcattcactgcaaaggccatcaaaaggtgtcagatcccatcgctcaaggcaacgcttatgctgataaggtagctaaagaagcagctagcattccaatttctgtccctcactgccagtttttctccttctcatcggtcacttccacctactcccccactgactaacttctacctatcaatctcttcccacacaagacaaatggttcttagaccaaggaaaattatctccttccagcctcacaggcccattctattctgtcatcatttcataacctcttccatataggttataagccgctagcccatctcttagaacctctcgtttcctttccaccgtggaaatctatcctcaaggaaatcacttctcagtgttccatctgctattctactactcttcagggattgtttaggccccctcccttccctacacatcaagcttgaggatttgcccctgcccaggactggcaaattaattttactcacatgcccggagtcaggaaactaaaacacctcttggtctgggtagacactttcactggatgggtagaggactttcccacagggtctgcgaaggccaccgtggtcatttcttcccttctgtcagatataattcctcggtttggccttcccacctctatacagtccaataacacacaggcctttactagtcaaatcacccaagcagtttctcaggctcttggtattcagtggaaccttcaggccccttaccatcctcaatcttcaggaaaggtaaaatggactaatggtcttataaaaacacacctcgccaagttcagcctccaacttaaaaaggactggacaatacttttaccacttgcccttctcagaattcaggcctgtcctcgggatgctacagggtacagcccatttgagcttctgtatggacgctcctttttgttaggctccaggctcattccagacaccagcccaacttggactgcaccccaaaaacttgtcatccgtactatcttctgtctagtcatactcctattcactgttctcaactactcataaatgtcctgctcttgttacactgctggtttacactgttgctccaagccatcacagctagtatctcctggtgctatccccaactgccagtcttaactcccttttagagtggatagatgatctttgctgacggggtacactccaatactttcaccctgacgaagtcctattctttacttttatactcattattattcttgttcccattcttatgccaccctctacctctccccagctatctccaccacactgccaatctcactctcacctagccatttctaatccttctttaacaaacaattgctggctttgcatttctctttcctccaaaatcgctgaggcctcaacttactcactgcaacaacaacaacaaaaaaagaaaggactctgtatatttttaaatgaaaagtgttgtttttacctaaatcagtctggcctggtatatgacaacataaaaatctaaaggatagagcctaaacttgccaaccaagcaagtaattatgctgaacccccttgggcactctctaattggaggtcctcccaattattagtcctttaatatctgtttttctcattctcttattcaaaccttgtatttagtttctcaattcatccaaaaccacatccaggccatcaccaatcattctatacgacaaatgctccttctaacaaccccacaatatcaccccttaccacaaaatcttccttcagcttaatctataccactctaggttcctatgctgcccctaatcctgctcgaagcagccctgagaaacattgcccattattgctccatatcacccccaaaaaatttttgctgccccaacacttcaatgctattttatgttatttttcttattaatataagaagacaggactatcaggcctctgagcccaagctaagccatcatatcccctgtgacctgcacgtatacatccagatggcctgaaggaagtgaagaatcacaaaagaagtgaaaatggccggtttctgccttaactgatgacattccaccattgcgacttgtttctgccccatcttaactgagcgattaaccttgtgaaattccttctcctggctcagaagctcccccactgagcaacttgtgacacacgcccctgctcataagagaaaaccccctttaactgtaatttttgactacccacccaaatcctataaaacggccccaccccatctcccttcgctgactcttttcggactcagcccgcctgcacccaggtgattaaaaagctctattgctcacacaaagcctgtttggtggtctcttcacctggacgcacgtga

SEQ ID NO: 66 - DNA, 757 bp, Homo sapiens
gtgaggcctctgagcccaagctaagccatcatatcccctgtgacctgcacgtatacatccagatggcctgaagtaactgaagaatcatagaagaagtgaaaatggcctgttcttggccaggcgtggtggctcatgcctgtactcctagcactttgggaggccgaggcgggcagatcacaaggtcaggagatcgagaccatcctggttaacacagtgaagtgaaaccctgcctctactaaaaatacaaaaaaactagccgggcgtggtggcgggtgtctgcagttccagctactcagaaggctgaggcaggagaatggtgtgaacccgggatgcggagcttgtagtgagccaaggttgcgccactgcactccagcctgggcgacagagcgagactccgtctgggggtgggcgggggagaaaggcctgttcctgccttaactgatgacattccaccacaaaagaagtgaaaatggccagtccctgccttaactgatgacattaccttgtgaaattccttctcctggctcatcgtggctcaaaagctcccccactgagcccttgtgacccctgcccctgcctgccagagaacaaccccctttgactgtaattttccactacccacccaaatcttacaaaacggcccccacccctatctcccttcactgactctcctttttcggactcagcccgcctgcacccaggtgaaataaacagccttgttgctcacacaaagcctgtttggtggtctctttacgca

SEQ ID NO: 67 - DNA, 3135 bp, Homo sapiens
tgactctctttttggactcagcccacctgcacccaggtgaaataaacagccatgttggtcacacaaagcctgtgtggtggtctcttctcatggacgcgcatgaaattcggtgccgtgactcggatcgggggacctcccttgggagatcaatcccctgtcctcctgctctttgctctgtgagaaagatccacctaccacctcaggtccttagacagacaagcccaagaaacatctcaccaatttcaaatccggtaagtggccactttttactctcttttccaatctccctcactatccctcaacctctttctcctttcaatcttggcgtcacacttcaatctctcccttctcttaatttcaattcctttcattttctgggagagacaaagcagacacgttttatcggtggacccaaaactccagcgcctgtcacggactgggaaggcagccttcccttggtgtttaatcattgcagggacacctctctgattattcacccacgtttcaaaggtgtcagaccacgcagggatgcctgccttggtccttcacccttagcagcaagtcccgcttttctgggggaggggcaagttccccaactccttctctccctctctaccccttctctgcttttctggggaaggggcaagtacccctcaaccccttctccttcgcccttagcggcaagtcccgcttttctagggggcaagaacccccaatcccttatttccgcaccccaacctcttatttctgtgccccaatcccttatttccatgccccgaccccccttcccacttttctggagggtaagaacccccgaaccccttccctccatatctctatgctctcttttctctgggtttgcctccttcactatgggcaaccttccaccatccattcctccttctcccttagcctgacttctcacgaacttaaaacctcttcaactcacacctgacctaaaacctaaacgccttattttcttctgcaatgctgcttgaccccaatacaaactcaacagtagttccaaatagccaaaaaatggcactttgaatttttccatcctgcaaaatctaaataattcttgctgtaaaatagacaaatggtctgaggtgcctgatgtccaggcattcttttacacatcagtcccttcctagtctctgtgcccaatgcaactcgtaccaaatcttccttctttccctcccgcctgtcccctcagtcccaaccccaagcgtcactgagtctttctaatcttccttttctacagacccatctgacctctcccctcctctccaggccaagctaggtcccaattcttcctcagcctcccctcctccaccctataatccttttatcacctcccctcctcacaccctgtctggcttatagtttcgttcagtgactagcccttccccacctgtccagcaatttattcttaaaaaggtggctgaagctaaaggcatagtcaaggtgaatgctcctttttctttatcccaaatcagatagcgtttaggctctttttcatcaaatataaaaatccagcccagttcatgacttgtttggctgcaaccttgagacgctttacagccctagaccctaaaaggtcaaaaggccatcttattctcaaaatacattttattacccaatgtgctcccgacattaaataaaattccaaaaattggaatctggccctcaaaccccacaacaggatttaattaacctcaccttcaaggtgtacagtaacagaaaaaaagttgcaattccttgcctccactgtgagacaaaccccagccacatctccagcacacaagaacttccaaatgcctgaaccacagcagccaggtattcctccagaacctccttccccaggagcttgctacacgtgccggaaatctggccactgggccaaggaatgccggcagcccgggattcctcctaagccgcgtcccatctgtgtgggaccccactgaaaatcggactgttcaactcacctggcagccactcccagagcccctggaactctggcccaaggctctctgactgactccttctcggcttagcggctgaagactgacgctgcctgatcacctcgaaagccccgtagaccatcacagacgccgagcttcgagtaactctcacagtggaaggtaagtccgtcgccttaatcaatacggaggctacccactccacattaccttcttttcaagggcctgtttcccttgcctccataactgttgtgagtattgacggccaggcttctaaacctcttagaactccccaactctggtgccaacttagatgatactcttttaagcactccttttagttatccccacctgcccagttcccttattaggccgagacactttaactaaattatctgcttccctgactattcctggactacagctacatctcattgccacccttcttcccaatccaaagcctcctttgcatcctcctcttgtattcccccaccttaacccacaagtataagatacctctactccctccttggcgactgatcatgcaccccttaccatctcattaaaaccttatcacccttaccctgttcaatgccaatatcccatcccacagcatgctttgaaaggattaaagcctgttatcactcgcctgctacagcatggccttttaaagcctataaactctccttacaattcccccattttgcctgtcctaaaaccagacaagccttacaagttagttcaggatctgtgccttatcaaccaaattgttttgcctatccaccctatggtgtcaaacccatatactctcctatcctccatacctccctccacaatccattattatgttctggatctcaagcatgctttctttactattcctttgctcccatcatcccagcctctcttcgctttcacttggactgaccctgacacccattaggctcagcaaattacctgggctgtactgctgcaaggcgtcacagacagcccccattacttcaatcaagcccaaatttcatcctcatctgttacctatctcagcataattcttcataaaaacacaggtgctccccctgctgctcgtgtccgattaatcccccaaacctcaatcccttacaaaacaactccttttcttcctaggtatggttag

SEQ ID NO: 68 - DNA, 714 bp, Homo sapiens
ttagagtagggagctaggcaaacatgagcaggacaggtgagggcccccacaggaatgtcaggctaccatcaggtgatggtcaggtggttgttaaactgtctctgtaaaataataattggttgcagccagctccaagcaaggacagtctctcaatagatacaaaacaccctgatctggtgatcagccgcttcccgataagatctcaggagctgggcaagcagcctggagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaagttaagggtcaggcagggcacttagatctctcaagttgcctgcctgacccaagtgtagtgtacttccttttgttcctgctctaaaactttttaataaactctcactcctgctctaaaacttgccttggtctctccctgtgccttaaaaccacttaaaaccacctctgcccctcagctgagttctgtctttgagaaggcaagcatcaagtttgctgcagacccattggattcaccactg

SEQ ID NO: 69 - DNA, 713 bp, Homo sapiens
ggaccaggccttttcaaaactatcaagcagatagtcagggcctgtgaagtgtgccaaagaaataatcccctgcactgcaggccatacatttcaatctctgtatctttaacctccttgttaagtttgtcttttccagaatcgaagctgtaaagccacaactcattcttcaaatggagccccagatgcagtccatgactaaaatctaccgcggacccctggaccggcctgctagcccatgctccaatgttaatgacatcgaaggcacccctccagaggaaatctcaactgcacaacccctactacaccccaattcagcaggaagcaattagagcagttgttggccaacctccccaacagcacttgggttttcctgttgagagggggtactgagaaacaggactagcaggatttcctaggccgattaagaatccctaagcctagatgggaagttgaccacatccacctttaaacacggggcttgcaactcagctcacacccgacccatcaggtaagaaagagagcccgctaaaatgctaattaggcaaaaacaggaggtaaagaaatagccaatcatctattgcctgagagcacagcgggagggacaatgatcaggatataaacccaggcattcgagccggcaacgactaccctctttgggtcccctccctttgtatgggagctctgttttcactctattaaatcttgcaactgca

SEQ ID NO: 70 - DNA, 74 bp, Homo sapiens
aaaacacttgaaatcagcagcttccaataaaatctcaggtagtgagtgagtgggcatgagcatgcacagtaaaa

SEQ ID NO: 71 - DNA, 5827 bp, Homo sapiens
gtcaggcctctgagcccaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctcgctcatcctggctcaaaaagcacctccactgagcaccttgcgaaccccactcctgcccgccagagaacaaaccccctttgactgtaattttcctttacctatccaaatcctataaaacggcctcacccttatctcccttcgctgactctcttttcggactcagcccgcctgcacctgggtgaaataaacagccatgttgctcacacaaagcctgtttgatggtctcttcacatggacgcgcatgaaatttggtgccgtgactcggatcgggggacctcccttgggagatcaatcccctgtcctcctgttctttgctccctgagaaagatccacctatgacctcaggtcctcagaccgaccagcccaaggaacatctcaccaatttcaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtggacccaaaactccggcgccggtcacggacagggaaggcagccttcccttggtgtttaatcattgcagggacgcctgattatacacccacgtttcaagggtgtcagaccacacagggacgcctgccttggtccttcacccttagcggcaagtcctgcttttctggggaaggggcaagtacctcaaccccttctctccttgtctctaacccttctctgcttttctgggagaggggcaagtacccctcaacccctcctctttcacccttagcagcaagtcccgcttttctacagggcaagaacccccaatctcttatttccgcaccccaacctcttatctctgcgccccaatcccttatttccgcaccccaacctcgtatctctgtgccccaatcccttatttccatgccccaaccccttatttccgtgccccgaccccttatttctgtgccccatcccttatttctgtgccccgacctcttatctctgtgccccaaccccttttcccacttttctggaaggtaagaacccccgaaccccttccctctgtttccctactctctcttttctctaggcttgcttccttgactataggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccaatgcaactcgtcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctataatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacgtgtttggcagcaaccctgagacactttacagccctagaccctaaaaggtcaaaaggccgtcttattctcaaaatacattttattacccaatctgctcctgacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacaaaagaacttccaaatgcctgaaccgcagcggccaggcgttcctccagaacctcctcccacaggagcttgctacacatgcaggaaatctggccactgggccaaggaatgcctgcagcccgggattcctcctaagccgcgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagacaatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctctgaaaactccccaactctgttgccaacttagaccatactcttttaagcactcctttttagttatccccacctgcccagttcccttattaggctgtgacactttaactaaattatctgcttccctgactattcctggactacagctatatctcattgccgcccttcttcccaatccaaagcctcctttgcatactcctcttgtatccccccaccttaacctacaagtataagatacctctactccctccttggcgaccaatcatgcaccccttaccatctcattaaaacctaatcacccttaccccactcaacgccgacatcccatcccgcagcacgctttaaaaagattaaagcctgttatcacttgcctgctacagcatggccttttaaagcctataaactctccttacaattcccccatttcacctgtcctaaaaccagataagccttacaagttagttcagaatctgcgccttatcaaccaaattgttttgcctatccaccccgtgctgccaaacccatatactctcctatcctcagtacctgcctctataacccattattctgttctagatctcaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcagcataattctcataaaaacacacgtgctctccctgccaatcgtgtccgactgatctctcaaaccacagcaacttctacaaaacaacaactcctttctttcctaggcatggttagtgtggtcagaattcttacacaagagccaggaccacaccctgtagcctttctgcccaaacaacttgaccttactgttttagtctagccctcatgtctgcgtgcagtggctgccactgcattaatacttttagaggccctcaaaatcacaaactatgctcaactcactctctacagttctcataacttccaaaacctattttcttcctcatacctgatgcatatactttctgcttcccagctccttcagctatactcactctttgttgagtctcccacaattaccgtcgttcttgacccagacttcaatccggcctcccacattattcctgataccacacctgacccccatgactgtatccctctgatccacctgacattcaccccatttccccaaatttccttctttcctgttcctcaccctgatcacgcttgatttattgatggcggttccaccaggcctaatccccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagttcgaggatttgccccacccaggactggcaaattagctttactcaacatgccctgagtcagataactaaaatacctcttagtctaggtagatactttcactggataggtagaggcctttcctacagggtctgagaaggccaccgcaggcatttcttcccttctgtcagacataattcctcagtttagccttcccacctcaatacagtctgataacggacgagcctttattagtcaaatcagccaagcagtttttcaggctcttaatattcagtgaaacctttatatcccttacggtcctccgtcttcaagaaaagtagaatggactaaaggtcttttaaaaatacacctcaccaagctcagccaccaacttaaaaaggactggacaatacttttaccactttcccttctcagaattcaggcctgtcctcagaatgctacaggggtacagcccatttgagcggtatagatgctcctttttattaagccccagtctcattccagacaccagagcaacttaagactgtgccccccaaaaaacttgtcatccctactatcttctgtctagtcatactcctattcaccgttctcaactactcgtacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagttgtcccaattcttagaccttttatacctgtttttctccttctgttattccatttagtttctcaattcatccaaaaccgtatccaggccatcaccaatcattctatatgacaaatgtttcttctaacatccccacaatatcaccccttaccacaaggcctcccttcagcttaatctctcccagtctaggttcccacgccgcccctaatcctgcttgaagcagccctgagaaacatcgcccattctctctccataccaccccccaaaaattttcgccgccccaacacttcaacactattttgttttatttttcttattaatataagaagccaggaatgtcaggcctctgagctcaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgactttaccttgtgaaagtccttttcctggctcatcctggctcagaaacacccccactgagcaccttgcgacccccgactcctgcccgccagagaacaaaccccctttgaatgtaattttcctttacctacccaaatcctataaaacggccccacccttatctcccttagctgactctcttttcggactcagcccgcctgcacccgggtgaaataaacagccatgttgctcacacaaagcctgtttggtggtctcttcacgcgcatgaaa

SEQ ID NO: 72 - DNA, 6026 bp, Homo sapiens
gtcaggcctctgagcccaagccaagccatcgcatccactgtgacttgcacatatacacccagatggcctgaagtaactgaagaatcacaaaagaagtgaacatgccctgccccaccttaactgatgacattccaccacaaaagaagtgtgaatggcgggtccttgccttaactgatgacattaccttgtgaaagtccttttcctagctcatcctgcctcaaaaagcacccccactgagcaccttgcgacccccactcctgcctgccagagaacaaaccctctttgactgtaattttcctttacctacccaaatcctataaaacggccccacccttatctcccttcactgactctcttttcggactcagcccgcctgcacccaggtgaaataaacagccacattgctcacacaaagcctgtttggtggtctcttcacacagacgcgcatgaaatttggtgccatgactcagattgggggacctcccttgggagatcaatcccctgtattcctgttctttgctccgtgagaaagatccacctatgacctcaggtcctcagaccaaccagcccaaggaacatctcaccaattttaaatcaggtaagcagcctcttcttactctcttctccaacctccctcactgtccctcaaccactttctcctttccaatcttcaatctctcccttctcttaatttcaattcttttcattttctgggagagacaaaggagacatgttttatccatggacccaaaactccggcgccagtcatggactgggaaggcagccttcccttggtgtttaatcattgcagggatgcctctctgattatacacccacgtttcaagggtgtcagaccacgcaggtacacctgccttggtccttcacccttagcagcaagttccgcttttctgggggaaggggaaagtacctcaatcccttctctccttgtctctaccccttctctgcttttccggggacaggacaagtaccccaaccccttctctccttgtctctaccccttctctgcttttctgggagaggggcaagtatccctcaaccccttctccttcactcttagctgcaagtcctgcttttctagaggaggggcaagtaccccaaccttgtatctctgtgccccgaccccttatttccatgccccgacaccttatttctgcaccccattccttatttccacacgctgacctctcatctctgcaccccaaccccttttcccacttttctggaaggtaagaacccccaaaccccttccctccatttctctactctctcttttctctaggcttgcttccttcactatgggcaactttccaccctccattcctccttctactcccttggcctgtgttctcaaaaacttaaaacctcttcaactcacacctgatctaaaacctaaatgacttttcttcttcaatgctgcttgaccccaatacaaactcgacagtagttccaaatagccagaaaatggcactttgaatttttccatcctgcaaaatctaaataattcttgtcgtaaaataggcaaacggtctgaggtgcctgacgtccaggcattcttttacacatcagtcccttcctagtctctgtgcccagtgcaactcatcccaaatcttccttctttccctcccgcctgtcccctcagtaccaaccccaagtgtggctgagtctttctaatcttccttttctacagacccatcagacctctcccttcctccccaggctgctcctcgccaggccgagctaggtcccaattcttcctcagcctctgctcctccaccctataatctttttatcacctcccctcctcacacctggtcctgcttacagcttcgttccctgactagccctccccctcctgcccagcaatttactcttaaaaaggtggctggagccaaaggcatagtcaaggttaatgctcctttttctttatcccaaatcagaagcgtttaggctctttttcatcaaatataaaaacccagcccagttcatgacttgtttggcagcaaccctgagacgctttacagccctagaccctaaaaggtcaaaaggccgtcttattctcaatatacattttattacccaatctgctcccgacattaaataaaactccaaaaattggaatctggccctcaaaccccaaaacaggacttaattaacctcaccttcaaggtgtacaataacagaaaaaagttgcaattccttgcatccactgtgagacaaaccccagccacatctccagcacacaagaacttccaaacgcctgaaccgcagcagccaggcgttcctccagaacctcctcccatatgagcttgctacacatgccggaaatctggccactggaccaaggaatgcccgcagcccaggattcctcctaagccacgtcccatctgtgtgggaccccactgaaaatcgcactgttcaactcacctggcagccactcccagagcccctggaactctggcccaaggctctctgactgactccttcccaggtcttctcggcttagcggctgaagactgacactgcctgatcgccttggaagccccctagaccatcacggacgccgagcttcgggtaactcttacagtggaaggtaagcccatccccttaatcaatatggaggctacccactgcatattaccttcttttcaagggcctgtttcccttgcctccataactgttgtgggtattgacggctaggcttctaaacctcttaaaactccccaactctggtggcaacttagacaatactcttttaagcactcctttttagttatccccacctgcccagttcccttattaggctgagacactttaaattatctgcttccctgactattcctggactacagctatatctcattgccacccttcttcccaatccaaagcctcctttgcgtcctcctcttgtattcccccaccttaacccacaagtataacccacctctactccctccttagtgaccgatcatgcaccccttaccatctcattaaaacctaatcactcttaccccgctaaacgccaatatcccatcccacagcacgctttaaaaagattaaagcctgttatcactcacctgctacagcatggccttttaaagcctataaactctccttacaactcccccattttacctgtcctaaaaccggacaagccttacaagttagttcaggatctgcgccttatcaaccaaattgttttgcctatccacccacggtgccaaacccatatactctcctatcctcaatatctgcctctacaacccattattctgttctaaatctcaaacatgcttttttcactattcctttgcccccttaatcccagcctctcttcgctttcacttggactgaccctgacacgcatcaagctcagcaaattacgtaggctgtactgccgcaaagctttacagacagcccccattacttcaatcaagcccaaatttcttcctcatctgttacctatctcggcataattcccataaaaacacacgtgctctccctgctgaccatgtccgactaatctctcaaaccccaaccccttctacaaaacaacaactcctttccttcctgggcatggttagatactttcgcctttggatacctggttttgccatcctaacaaaaccattatataaactcacaaaaggaaacctagctgaccccatagatcctaaatcctttccccactcctctttctgttccttgaagacagctttagaaactgctcccactctagctctccctgactcatcccaaaccttttcattacacacagctgaagtgcagggctgtgcagtcggaattcttacacaaggaccaggatcgcatcctgtagcctttttgtccaaacaacttgaccttactgttttaggctggccatcatgtctccatgcagcagctaccgctgctttaatacttttagaggccctcaaaatcacaaactatgctcaactcactctctacagttctcataacttccaaaatctattttcttcctcatacctgacgcatatactttctgcttcccggctccttcagctatactctttgttgagtctcccacaattactgttgttcctggcccagacttcaatccggcctcctacattattcctgataccacacctgagccccatgactgcatctctctgatccacctgacattcaccccatttccccaaatttccctctttcctgttcctcagcctgatcacgcttgatttattgatggcggttccaccaggcctaatcgccacacaccagcaaaggcaggttatgctatagtacaagccactagcccacatcttagaacctctcatttcctttccattgtggaaatctatcctcaaggaaataacttctcagtgttccatctgctattctactactcctcagggatagttcaggccccctcccttccctacacatcaagctcaaggatttgcccccacccaggactggcaaattagctttactcaacatgcccgagtcaggaaactaaaatacctcttagtctaaatggacactttcactgaataagtaaaggcctttcctacagggtctgagaaggccaccacagtcatttcttcctttctgtcagacataattactcagtttagccttcccacctcaatacagtctgataacagacgagcctttattagtcaaatcagccaagcagtttttcaggctcttagtattcagtgaaacctttatatcccttatggtcctccgtctttaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaagctcctgtatagacgctcctttttattaggccccagtctcattccagacaccagaccaacttagattgtgccccacccccccaaaaaaaaaattgtcatccctactattttctgtctagtcatactcctattcaccattctcaactactcatacatgccttgctcttgtttacactgccggtttacactgtttttccaagccatcacagctgatatctcctggtgctatccccaaactgccattcttaactcttgaagtaaataaataatctttgctggcaggactatgccgaatctccttaagcactctctaatcagatatcctgagtcgtcccaattcttagaccttttatacctgtttttcttcttctgttattccatttagtttttcaattcatacaaaaccgtatccaggccgtcaccaatcattctatatgacaaatgtttcttctaacatccccacaatatcacgccttaccacaagacctcccttcagcttaatctctcccactctaggttcccacatcgcccctaatcccgcatgaagcagccctgagaaacatcgtccattctctctccataccaccaccccaaaattttcactgccccaacacttcaacactattttgttttatttttcttattaatacaagaaggcaggaatgtcaggcctctgagcccaagccaagccatcgcatcccctctgacttgcacgtatatgcccagctggcctgaagtaactgaagaatcacaaaagaagtgaacatgccctgccccaccttaactgatgacattccaccacaaaagaagtgtgaatggcgggtccttgccttaagtgatgatattaccttgtgaaagtccttttcctggctcatcctggctcaaaaacacccccactgagcaccttgcgaccccccactcctgcccgccagagaacaaaccccctttgactgtaattttcctttacctacccaaatcctataaaacggccccacccttatctcccttcactgactgtctttttggactcagcctgcctgcacccaggtgaaataaacagccatgttgctcacacaaagcctatttggtggtctcttcacagggacgcgcataaaa

SEQ ID NO: 73 - DNA, 10188 bp, Homo sapiens
aggaggactccttcaggagactgatcccctgtcctgatctccatgaggagctccagctacgacctcaggtcctcagaccaaccagcccaaggaacgtctcaccaatttcaaattgggtaagtggtctttttactgtcttctccaactttgtcactatccctcatcatctttctcctttcaatttcagcaccacctttcaatctctcccttcccttaatttcagttcctttccttttctggtagagacagaggagacatgttttatccatgaacccaaaactccagcgctggtcacggacttgggaagacagtcttcccttggtgtttaatcactgcagggatgcctgtctgattattcacccacatttcagacttgttcaatcaccacagggacacctgccttgatcctccaccttggtggcaagtaccatttcctctttgtggcaagtaccaccccactctctctgtgtctctacccctcttttctctaaacttacgtttttactatgggcaaccatccaccctccattcctcctacttcccccttagcctgtgttcttaaaaacttgaaacctcttcaactctcacctgatctaaaacctaagcatcttattttctcctgcaacactgtttggccccaatacaaacttgataatggctctaaatggccagataatggcacttttgatttctccatcctacaagacctaaataatttttgtcataagatgggtaaatggtctgaggtgccttatgtccaggcattttttcacttcacttcctccctagcttctggtcccaatgtgactagtcccaaatgcttctttccctcctgcctgtcccttcagtcccaacaccaactgctgctgagtcttctgaatcctccttttctgaagacccctcttacctctctccccctccccaggccactcctcagaaggctgaatcaagtcccaattcttcctcagcctccactcccccaccctgtaaccctgctgtcacctcccctccccacacccagttcggcttacaatttcgttctgcagcaaatactccccaacctgcccaacaatttcctctttgagaagtgcctggagctgagggcatcggcagagtgcatgtaccattttctctatcagacctttcccaaattaatcaacacttaggccccttctcgtgagacaccactaaatatatacaggaattccagtatttaatccaatactacaacttaacctggagtgacttaaatgtcatcctaccttctaccctttccccagatgagtgggatagagtttataccctagcccagtcccacactgacacctgcaggcctcatgagccaaaccttcaacaaggcatctgggtagttccccaagaagatccctaatgggaataccagacaggctccccaggtatagctaggcaagattatgatttcctgcctagttgaagtgcttaaaaaggcagcttacaaagctgttaattatgacaaacttaaacgacccaaggtaaagatgaaaacccagcccagttcatggttcatctggcagcaattctgagacactttacagccctagaccctgaagggtcagaaggctgtctcattctcaatatgcattttatcaaccagtcagctcctgacattagaaaaaagcttcaaaaattggaatccagtcctcaaaccccacaacaggaattaatcaacctcaccttcaaagtgtgcaataatagagaggaggcagccaaatggcaatgcatttctgagttacaattacttgcctctgctgtgagacaaaactcagctgcagctccagcacacaagaacttcaaaacgcctaagctgcagtggtcaggcattcctacaggacctcctctctcaggatcttgcttcaagtgccagaaatctggccactgggccaaggaatgcctgcagccagggattcctcccaagccacgtcccatctgtgcagggacccatggaaatcagactgtccagctcacccagaagccactcctagagcccctaaagctctggcccatggctctttgactccttcccagatctgctcggcttagcagctgaagactgtcactgcccaattgcctcggaagccctctggaccatcagggatgctgagctttgggtaactcttacagtggggcgtaagtccatcccctgtttaattgatacaggggctaaccactccacattaccttcttttcaagggcctgtttcccttgcctccataactgttgtgggtattgatggccaggctcctggaccccttaaaacttcccaatttggtgccaacttgaacaatattcttttatgcactcctttttagttatccccacctgcccagttcccttattaggctgagacattttaaccaaattacctgcttccctgactattcctggactacagccacatctcattgccgcccttcttcccaacccaaagcctccttcacgtcttcctcttgtatccccccaccttaacccacaggtatgggacacctctgctccctccctggcaactgatcacacacccatacctaatcacccttaccctgctcaacaccagtatcccatcccacaacaggctttaaggggattaaagcctgttatcactcgcctgctacagcatgagcttctaaagtctaaaaactccttatgattcccccattttaagtgtccaaaagctggacgagtcttacaggttggttcaggatctgtgccttttaaaccaaattgttttgcctatccaccctgtggtgcccaacctgtacactcttttgttctcaatactgccctccacaactcactattccattcttgatcttaaacatgcttttttcactattcccctgcacccctcatcccagcccctctttgcttttacctggactgacactgacactcatcagtcccagcagcttacctgggctgtactgccgcaaggcttccgggatagccctcattacttcagccaagctctttctcatgatttactttcttttcactcctctgcttcctaccttattcaatacattgatgaccttctactctgtagtccctactttgagtctttgcaaaaggatatcctcctactccttcaacatttattctccaaaggatatcaggtatcccccaccaaagctcaaatttcttccccatccattacctaccttggcataattcttcatgaaaacatgcatgctatccctgccaactgtgtccagctgatctctcaaaccccaaccccttctataaaacaacaactcctttccttcctgggcatggttggatactttcacctttggacacctggctttgctgtcctaacaaaaccattgtatcaactcacaaagggaaacctagctgaccgcacagatcctaaatcctttccccactcgtctttccgttccttgaagacagctctggagactgctcccacactagctctccctgactcatcccaacccttttcactacacacagccgaagtgcagggttgtgcagtcggaattcttacacaaggaccaggactgcaccctgtagcctttttgtccaaacaacttgaccttcctattatacgctggccatgatgtctccgtgcagctaccaccaccctaatacttttagaggccctcaaagtcacaaactatgctcaactcactctccacatttctcataacttcccaaatctattttcttcctcacacctgatgcatatactttttgctccctggctccttcagctatactcactctttgttgagtctcccacaattaccattgttcctggcccagacatcaatccagcctgccacattattccagataccacacctgacccccatgactgtatctctctgatccccctgacattcactccatttccccctcctttcgtgttcctcatcctgatcacatttggtttattgatggcagttccaccaggcctaatcgccactcaccagcaaaggcaggctatgctatagtatcttccacatctatcattgaggctaccactctgccccactcccacagcctctcagcaagcagaactcattgcctaaactcaggccctcactcttgcaaagggactacacatcaatatttatactgactcaaaatataccttccatatcttgcaccaccatgctgttatatgggctgaaagaggtttcccccctatgcaagtgtcctccatcattaatgcctccttaataaaaactcttctcaaggccgcattctccttatgtcaagtctactccccccatatttggactccccacaacacaagctactatttctgtggtcactccattatgtatctctcagcaaagacccactggaattcccctggggaacttttcaccttctcaatgctccttcactcttcatctccaaagcccaactacatatatcacagaaacaattggggccttccagctccgtattacagacaagacatctatcaatactggcaaacttaaaaacattattgcttaggaaaacatttaccctgtatttcactccatccttggctaccttccccttgctcttcagactctcctcccaggccctcttcttatttacttatatccagccccataaataacagtgaaagtttgcttgtagacactcaatgctttctcatacaccatgaatattgaacctccccctctacacagttaccccatcagtccccattacaacctctgatggctgccgccctagctggatccctgagtctgggtaaaagacacctcttttagcacttcttctcatcttttcactttgcatttccaattttgccttgcaaaaggcctcttcttctgtggctcctccgcttacatgtgtctgcctgctaatcggacagggacatgtacactcatttttctcattcccaaaattcaatttgcaaatgggactgaacaacttcctatcccactcatgataccaaacagacaaaaaagagttattcctctaatccctctacttatagggttaggactttctgcttccactattgcccttggagctggaatagcaggcatttcaacttctgtcacgaccttccatagcctttcaaatgacatttctactagcattacagatatatcacaaactttatcagtccttcaggccaagtcaactcttagccccagttgtcctccaaaattgctgaggcctggacttactcactgctgaaaaaggaggactctgtatatttttaaatgaagagtattgtttttacgtaaatcagtctggcctggtatatgacaacataaactcaaggatagagcccagaaatttgccaaccaggcaaatcattacacaggacccatctggacactttctaactgagtgtcttggctactccctattcttagtcccctggtacctgtttttctccttctcttattcaggccctgtgtcttccatttagtttctcaattcatacaaaaccacattcagaccatcaccaatcattctatatgacaaatgctacttttaacaaccccacagtaccatcccccgcaccaagatctccccacagcctaaatccctattccttgtaactcattataaaattttccttaaggtgtccacgcagctcctaatctcactcgaagcaaccctgagaaacatcatccattatctctccataccacccccaaaaatttttgccaccccaacacttcactattttgttttatttttcttattaatataagaagacaggaatgtcaggcctctgagcccaagactgcaggtatacatccagatggcctgaggcaaccgaaaagtacaaaagaagtgaaacagccagcccctgtcttaactgattgaccaaccttatgactttccattatgacttgttcctgccctgccccaactgatcgatcgaccttgagaaattcttctggacaatgagtcttatgatctccccacaatgcaccttgtgacgctctcctctgctgacaatagataaccacctttaactgtaactatccactgcttaccccaggcctataaaactgccccaccccatctccttttgctgacttctttttcagacccagtctgcctgcacccaggtgaaataaacagccttgttgctcacacaaagcctatttggtggtctcttcacacagacgagcatgacactgcagtctagttgagggtggagggtgggaggaaggagaggcataaaaaagaaaaactattgggggccaggtgttgtggttcatgcctgtaattccagcactttgggaggccgaggtgggtggatcacctgaggtcaggaattcaagaccagcctggccaatgtggtgaaaccctctctctactaaaaatacaaaaattagccaggcatgatggcaggcacctgtaatcccagctactgaggcaggagaatcccttgaacctgggaggcagaaattgcaatgagctgagatcataccagtactctggcctgagcaaaagagcaaaactcagtctcaactaaataaataaataaatattgggtactgggcttaatgtcaaggtgatgaactactctgtacaacaaaccccgatgacacgagtttacctgtgtaacaaaccttcacatgtagccccaaacctaaagtaaaaaaatgaatattgtcaggcctctgagcccaagctaagccatcatatcccgtgacctgcacgtacacatccagatggccagttccttccttaactgatgacattccaccacaaaagaagtgaaaatggcctgttcctgccttaactgatgacactgtcttttgaaattccttctcctggctcatcctggctcaaaagctcccccactgagtacgttgtgacacccactcctgcccaccagagaacaacccccctttttcctttacctacccaaatcctataaaatggcccaacccctatctatctccctttactctctttttggactcagcccacctgcacccaggtgaaataaagttttattgctcacacaaagcctgtttggtggtctcttcacacggacacgcatgaaatttggtgccatgactcagattgggggacctcccttgggagatcaatcgctgtcctcctgctctttgctccatgaggaagatccacctacgacctcaggtcctcagactgaccagcccaagaaacatctcaccaatttcaaatccggtaagtggcctctttttactctcttctccaacctccctcactatccctcaacctctgtctcctttcaatcttggcaccacacttcaatctctcctttctcttaatttcaattcctttcattttctggtagagacaaaggagacacgttttatccgtggacccaaaactcgggcgccggtcacggagtagggaaggcagccttcccttggtgtttaatcattgcagggacgcctctctgattattcacccaggtttcagaggtgtcagaccacacagggacgcctgccttggtccttcacccttagcagcaagttccgcttttctagggaaggtgtaagtaccccaacaccttctctctgtgtctctaccccttcttcgcctttctggggggcaagaaaccccaaccccttctccttcacccttagcagcaagtcccacttttctaggggaggagcaagtaccccaaccccttatatctctgcaccccaatcccttatttccatgccccaacctcatatatctctgtgccccaacctcttatatctctgtgccccaatcccttatttccatgccctgacctcatatctctgtgccccaaccgctttcccacttttctggaggtaagaacccccaaaccccttccctccgtgtctctactctcttttctctgggcttgcctccttcactataggcaatattccaccctccattcctccttctccctttcctgtgttcttaagaacttaaaacctcttcaactctcacctgacctaaaatctaagcatcttattttcttctgcaatgccgctggaccccaatacaaactcgacagtagttccaaatagccagaaaacagcactttcaatttttccaccctgcaagatctaaataattcttgtcataaaataagcaaacggtctgaggtgcctgacatccaggcattcttttacacatcggtccctgtgcccagtctctgtgcccagtgcaactcatcccaaatcttccttctttccctcctgcctgttccctcagtcccaaccccaagcatcgctgagtctttctaatcttccttttctacaggcccatctgaactcttcccctcctccccaggctgctccttgccaggccgagctaggtcccaattcttcctcagcctccgctcctccaccctgtaatctttttatcacctcacctgctcacacccggtccggcttacagttttgttccgtgactagccctcccccacctgcccagcaatttactcttaaaaaggtggctggagctaaaggcatagtcaaggttaatgctcctttttctttattccaaatcagataacgtttaggctctttttcatcaaatataaaaatccagcccagttcatgactcgtttggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacctcaccttcaaggtgtacaataatagaaaaaagttgcaattccttgcctccactgtgagacaaaccccagccacatctccagcacacaagaacttccaaacgcctgaaccacagtggccaggcattcctccagaacctcctcccccaggagcttgctacaagtgccagaaatctggccactgggccaaggaatgcccgcagcccaggattcctcctaagccgtgtcccatctgtgtgggaccccactgaaaatcggaccgttcaactcacttggcaaccactcccagagcccctggaacgctggcccatggctctctgactgactccttcccagatcttcttggcttagtggctgaagactgacactgcccgatcgcctcggaagcctacaggaccatcacagatgctctaagtaactctcacagtggaaagtcagtctgtccccttcttaatcaatacggaggctacccactccacattaccttcttttcaagggcctgtttctcttgcctccataactgttgtgggtattgacagccaggcttctaagcctcttaaaactcccccactctggtgccaacttggacaacactcttttatgcactcttttttagttatccccacctgcccagttcccttgttaggctgagatattttaaccaaattatctgcttccctgactattcctggactacagccgcatctcactgctgcccttctccccaacccaaagcttccttcgcatcctcctctcgtatccccccaccttaacccacaagtatgggacatctccactccttccctggcaactgctcacatgcccgttaccatcccattaaaacctaatcacccttaccccactcaacgccagtatcccatcccacagcacgctttaaaaatattaaagcctgttatcactcgcctgttacagcatggccttttaaagcctataaactctccttacaactcccccattttacctgtcctaaaaccagataagacttaataggttagttcaggatctgcaccttatcaaccaaattgttttgcctatccaccccatggtgccaaacccatatactctcctatcctcagtacctgcctctactacccattattctgttctggatctcacacatgctttctttactattcctttgcacccttcatcccagcctctcttcgctttcacttggactgaccctgacacccattaggctcagcaaattacctggggctgtactgccgcaaggcttcacagacagcccccattacttcagtcaagcccaaatttcttcctcatctgttacctatctcagcataattctcataaaaacacatgtgctctccctgctgatcgtgtccaattaatctcccaaacctcaatcccttacaaaacaacaactcctttccttcctaggcatagttag

SEQ ID NO: 74 - DNA, 5355 bp, Homo sapiens
gtcaggcctctgagtccaagcctgcacgtgtacatccagatggcctgaggcaactgaagaaccacaaaagttgaaaatggccagttcctgccttaactgatgacattaccttgtgacattccttctcctggacaacaagtctccggagctccccgccgagcaccgtgtgaccaaccccccacccccaccccgcctcactgcccgaaagagaacaaccgtctttaactgtaattttcaactacctacctgaaccttataagactgccccacccctatctccctttgctgattctctttttggactcagtccacctgcaccaggtgattaaaaagctttattgctcacacaaagcctgtttggtggtctcttcatacagacgcgcgtgacatttggtgacgaagacccaggataggggactcttctgggacaccggtcccctgtccttgccctcactctgtgaagagatccacctacaacctctggtcctcagaccaaccagcccaaggaacatctcaccaatttcaaatcaggtaagtggtcttttcactctcttctccagcctctctcgctacccttcagtctccctgtccttccaattccagttctttttcctctctagtagagacaaaggagacacattttatctgtggaccccaaactcccacgctggtcatggactcaggaagacagtcttcccttggtgtttgatcatcacggggatgcctgccttgatcattcacccacattccattggtgtctgatcaccacaaggacacctgccttgatcattcatctacatttcctcggtggcaagtcaattgcgggaatgcctgctttggctgctcacccacattacagcccagggctgctcaccacccccttctccgtgtctctacttttctctttaaacttacctccttcattatggacaaccttccatcctccagtcccccttcttctcccttagcctgtgttttcaagaacttcaaatcggtccctccctaatctccgctcccaatgtgactcatcccaaatctttctttctctcctgtctgttccttcaatctccaccccaagctctgagtcctttgaatcctccttttctgtggacccatctgacctctcccctcctccccaggctgctcctcaccaagacgcgccgggtcccaattcttactcagcctccactcccccaccctataatccttctatcacctcccctcctcacacacacctcccctcctcacactctggcttacagtttctttctgcaactagccctccccccacctgcccaacaatttcctcttacagaggtggctggagatgaaggcatagtcaagattaatgctcctttttctttatccgacctctcccaaatcaattagcatttaggctgttttttatcaaatataaaaacccagcccagttcatggcccttttggcaacaacccttagatgctttaccgccctagacccagagaggccagaaggccgtcttattctcaatatgcattttattatccgatctgctcccgacattagaaaaagctccaaacattagattctggccctcaaaccctacaacaggacttagttaacctcgccttcaaggtgtacaataatagagaagaggcagccaagtggcaacgtatttctgagttgcaattacttgctttcattgtgagagaaactccagccacatctctagcacacaagaacttcaaaacacctaaaccgcagtggccaggcatttctccaggacctcttccccaaggattttgtttcaagtgctggaaatctggccactgggccaaggaatgcccacagcccgggattcctcctaagctgtgtcctatctgtgcaagaccccactggaaatcagactgtccaactcacccggcagccactcccagagcccctggaactctggcccaaggctctctgactgactccttcccacttagtggctgaagactgacactgcctgatcagctcagaagcctcctggactatcacagatgctttgggtaactcttacagtggtgggtaagtctgtccccttcttaatcaatagggaggctacccactccacattaccttattttcaagggcctttttcccttgcctccacaactactgtgggtattgacagtcaggcttctaaacctcttaaaattccccagctctggtgccaacttggacaacattcttttatgcactcctttttagttatccccacctgcccagctcccttattaggttgaggcattttaactaaattgtctgcttccctgactattcctgggctacagtcacacctcattgccacccttttccccagttcaaagcctccttcgcatcttccccttgtatctccctaccttaatccacaagtatgggatacctctactccctccttggcgatcatgcaccctttatcatcccattaaaacctaatcacccttgccccactcaatgccaatatcccatcccacagcaggctttaaaaaggttaaagcctgttatcacctgcctgttacaacatggcctcttaaggcctacaaactctccttacaacctttctatcctacctttccaaaaccagacaagtcttacaggctggtccaggatattcgacttatcaaccaaattatcttgcctatccaccccatggtgccaaatccatatattctcccatcttcaatacttccctccacaacccattattctattctggatttcaaagatgctttctttactattcctttatacccttcatcccagcctctcgttcctttcacttggattgaccctgacacccatcagtctcagcaatttaacccgggctgtaccgctgcaaagcttcagggacagtccccattacttcagtcaagccctttctcataacttactttctttccatccatctgcttctcaccttattcaatattttaatgaccttctactttgtagacccctgtgaaacttcccaaaaggacaccctcctgctcttccaacatctattctcaaaaagatattacatatccccctccaaagcccagatttcttcctcatccattacctatctcagcataattcttcataaagacacacgtgctctccctgctgatcatgtccagctaatctctcaaaccccaaccccttctacaaagcaacaactcctttccttcctaggcatggttgggtactttcgcctttggatacctggttttgctatcctaaaaaaaaacccattatataaactcagaaagggaaacctagctgaccctatagatcctaaatcctttcccaactcaatatttacactgactctaaacatgctttccatatcctgcaccaccatgctgttatatgggctgaaagaggtttcctcactacaccagggtcctccatcattaatgcctctttaataaaaactcatctcaaggccgcattacttccaaaggaagctggagtccttcattgcaaagccatcaaaaggcctcagatcccattgctcaaggcaacaattatgctgataagacagctaaagaagcagccagtatttttctttctcctctatcactcccacctactctcccactgaaacttccgcgtatcagtctcttcccacagaagccaaatggttcttggaccaagaaaaattcctctttccagcctcacaggctcatcccattctatcatcctttcataacctctaccttgtaggttacaagccttactaacccacatcttagaacctctcatttcctttaagacatttgcccttcatatcactccatccttggctaccttccccttcttctttgaactcttctcctagcctctcctcttgcttgcttatacccagccccatgaatagcagtgaaaggttactcatacacactatgcgctttctcatacaccataaaaatagaacctcccccctacccagttgccccatcaatccccattacaacctctaagggttgctgccctcactaaatccctaagagtctgggtgcagggtttcaaagatgctttctttactattcctttagacccttcatcccagcctctcttcactttcacttggactaaccctgagacccatcagtctcagcaacttaacctgggctgtgctgcctcaaggcttcagggacagcccccattacttcagtcaagcccttttggtgctccctctcatcttttcactttacatttccagttttgccttacaaaggtctcttcctcctctgtgattcctccacctacatgtgtctatccatcaattggacaggcacatgtacactagttttctttaccccccaaaatcaattttcaaatagggctgaacaacttcctattccccttatgacaccaacacttcactactattttgttttttattattattaatataaaaagacaggaatagtcctcaacttactcactactgaaaaagaaagactctgtacatttttaaatgaagagtgttgtttttacctaaatcaatctggcctgctacacgacaacataaaaaaactcaaggatagagcccaaaaactcaccaaccaaacaaataattacactgaacccccttggacattctctaattggatgtcctaggtcctctcaattcttagtccttcaatacctgtttttctccttctcttaatcagaccttgtgtcttctgtttagtttctcaattcaaacaaaacagtatccaggccatcaccaatcattctatatgacaaatgctccttctaacaaccccacaatatcaccctttaccccaaaatatttcttcagtttaatctctcccacactaggtttccaagccacccctaatccctctcgaagcagccctaagaaacatcacccattatcactccataccaccccccaaaatttttgctgctccaacacttgaccactattttgttttgtttttcttattaatataagaagacaggaatgtcaagcctctgagcccaagcctgcacgtatacatccagatggcctgaggcaactgaacaacctcaaaagaagtgaaaatggctggttcttgccttaactgatgacattaccctgtgacattccttctcctggacaataagtctccagagctccccactgagcaccttgtgacccctgccactgcccgcaagagaacaacctcctttaactgtaattttccactacctacccaaatactataaaactgcaccatcccatctccctttgctgactctcttttcagactcagcccgcctgcacccaggtgattaaaaagctttattgctcacacaaagcctgtttggtggtctcttcacatggatgcgtgtga

SEQ ID NO: 75 - DNA, 14147 bp, Homo sapiens
gtcaggcctctgagcccaagccaagccatcacatcccctgtgacttgcacatatatgcccagatggcctgaagtaactgaagaatcacaaaagaagtgaatatgccctgccccaccttaactgatgacattccaccacaaaagaagtgtaaatggccggtccttgccttaactgttgacattaccttgtgaaagtccttttcctggctcatcctggctcaaaaagcacccccactgagcaccttgtgacccccactcctgcccgccagagaacaacccccctttgactgtaatattcctttatctacccaaatcctataaaacggccccacccctatctcccttcgctgactctctttttggactcagtccacctgcacccaggtgattaaaagctttattgctcacacaaagcctgtttggtggtctcttcacagggacgtgcatgaaatttggtgccgtgactcgatcgggggacctcccttgggagatcaatcccctgtcctcctgttctttgctccatgagaaagatccacctacgacctcaggtcctcagaccgaccagcccaaggaacatctcaccaattttaatcaggtaagcggcctcttcttactctcttctccaacctctcccactgtccctcaaccactttctcctttccactcttcaatctctcccttctcttaatttcaattcctttcattttatgggagagacaaaggagacacgttttatccgtggccccaaaactccagcgccggtcacggactgggaaggcagccttcccttggtgtttaatcactgcagggacgcctctctgattattcacccacgtttcaaaggtgtcagaccacgcagggacgcctgccttggtccttcacccttagtggcaagtcccacttttctgggggaggggcaagtaccccaaccccttctccttcactcttagtggcaagtcccgcttttctagaggaggggcaagcaccccaaccttgtatctctgccccccaatcccttatttccacgccccaacctcttatatctctgcaccccaatcccttatttctgtgccccgaccccttatttccgtgccctgaccccttatttccatgccttgaccccttatttctgtgccccatcccttatttctgtgccctgacatcttttctctgcaccccaaccccttttcccacttttctcgaaggtaagaactcccgaaccccttccctccatttctctactctctcttttctctaggcttgcttccttcactataggcaaccttccaccctccattcctccttctactcccttagcctgtgttctcaaaaacttaaagcctcttcaactcatacctgacctaaaacctaaatgccttattttcttctgcaatgccacttgaccccaatacaaactcgacagtagttccaaatagccagaaaatggcactttgaatttttccatcctgcaagatctaaataattattgtcgtaaaataggcaaacggtctgaggtgcctgacgtccaggaattcttttacacatcagtcccttcctagtctctgtgcccagtgcaattcatcccaaatcttccttctttccctcccgcctgtcccctcagtaccaacccaaagcatcgctgagtctttctaatcttccttttctacagacccatctgacctctcccttcctccccaggctgctcctcgccaggccgagctaggtcccaattcttcctcagcctctgctcctccatcctataatctttttatcacctcctctcctcacacctggtccggcttacagttttgttccgtgactagccctccccctcctgcccagcaatttactcttaaacaggtggctggagctaaaggcatagtcaaagttaattctcctttttctttatcccaaatcagatagcctttaggctctttttcatcaaatataaaaatccagcccagttcattacttgtttggaagcaaccctgagacactttacagccctagaccctaaaatgtcaaaaggccgtcttattctcaagatacattttattacccaatctgctcccgacattaaataaaactccaaaaattaaattccggccctcaaaccccacaacaggatttaattaaactcgacttcaaggtgtacaataatagaaaaaagttgcaattccttgcctccactgtgagacaaaccccagccacatctccagcacacaagaacttccaaacgcctgaaccgcagcggccaggcattcctccagaacctcctcccacaggaacttgctacatgtgccggaaatctgaccactgggccaaggaatgcccgcggcccaggattcctcctaagccgtgtcccatctgtgtgggaccccactgaaaatcagactgttcaactcacctggcagccactcccagagcccttgaaactctggcccaaggctctctgactgactccttcccagatcttctcggcttagcagctgaagactgatgcttcccgatcgcctcggaagccccctagaccatcacggatgccgagcttcgggtaactctcacagtggaaggtaagcccatccccttcttaatcaatacggaggctacccactccatattaccttcttttcaagggcctgtttcccttgcctccataactgttgttggtattgatggccaggcttctaaacctcttaaaactccccaactctggtgccaacttagacagtactcttttaagcactcctttttagttattcccgcctgcccagttcccttattaggctgagacactttaactaaattatctgcttctctgactattcctggactacagctatatcttattgcctcccttcttcccaatccaaagcctcctttgcgtcctcctcttgtatccccccaccttaacccacaagtgtaagatacctctactccctccttggtgaccgatcatgcaccccttaccatgtcattaaaacctaatcacccttaccccactcaaggccagtatcccatcctgcagcatgctttaaaaagattaaagcctgttatcactcacctgctacagcatggccttttaaagcctataaactctccttacaattcccccattttacctgtcctaaaaccagacaaggcttacaagttagttcaggatctgcaccttatcaaccaaattgttttgcctatccaccctgtggtgccaaacccatatactctcctatcctcaatacctgcctctataacccattattctgttctagatctcaaacatgctttctttactattcctttgcacccttaatcccagactctcttcgctttcacttggactgaccctgacatccatcaagctcagcaaattacctaggctgtactgccgcaaagcttcacagacagcccccattacttcaatcaagcccaaatttcatcctcatctgttacctatcttggcataattctcataaaaacacaggtgctctccctgccaatcgtgtccgactgctctctcaaacccaagcaccttctacaaaacaacaactcctttccttgctaggcttgattagcactgtcagaattcttacacaagagccaggaccacaccctgtagcctttctgtccaaacaacttgaccttactgttttagcctagccctcatgtccgtgtgcagtggctgccactgctttaatacttttagaggccctcaaaatcacaaactatgctcaactcactctctacagttctcataacttccaaaatctattttcttcctcatacctgatacatatactgtctgctccccggctccttcagctgtactcactctttgttgagtctcccacaattaccattgttcctggcacagacttcaatctggcttcccacattattcctaatgccatacctgacccccatgactgtatctctctgatccacctgacattcaccccatttccccaaatttccttctttcctgttcctcaccctgatcatgcttgatttattgatggcggttccaccaggcctaatcgccacacaccagcaaaggcaggttatactatagtacaagccactagcccgcctcttagaacctctcatttcctttccattgtggaaatctatcctcaaggaaataacttctcagtgttccatctgctattctactactcctcagggattattcaggccccctcccttccctacacatcaagctcgaggatttgccccacccaggactggcaaattagctttactcaacataccctgagtcagataactgaaatacctcttagtctaggtagatactttcactggataggtagaggcctttcctacagggtctgagaaggccaccacagtcatttcttccattctgtcagacataattcctcagtttagccttcccacctcaatacagtctgataacagaccagcctttattagtcaaatcagccaagcagtgtttcaggctcttagtattcagtgaaacctttatatcccttacagtcctccatcttcaagaaaagtagaatggactaaaggtcttttaaaaacacacctcaccaagctcagccaacaacttaaaaagcactggacaatacttttaccactttcccttctcagaattcaggcctgtcctcagaatgctacagggtacagcccatttaagctcctgtatagacgatcctttttattaggccccagtctcattccagacaccagaccaacttagactgtgccccaaaaaacttgtcatccccactatcttctgtctagtcatactcctattcaccgttctcaactactcatacatgccctgctcttgtttacactgccggtttacactgtttttccaagccatcacagctgatacctcctggtgctatccccaaactgccactcttaactcttgaagtagataaataatctttgctggcaggactatgctgaatctccttaggcactctctaatcagatatcctgagttgtcccaattcttagaccttttatatctgtttttctccttctgttattccatttagtttctcaattcatccaaaaccatatccaggccatcgccaatcattctatatgacaaatgtttcttctaacatccccacaatatcaccccttaccacaagacctcccttcagctaaatctctcccactctaggttcccacgccgcccctcatcccgcttgaagcagccctgagaaatatcacccattctgtctccataccaccccccaaaaattttcactgccccaacacttcaacactattttgttttatttttcttattaatataagaaggcaggaatgtcagtcctctgagcccaagccaagccatcgcatcccctgtgacttgcacgtatatgcccagatggcctgaagtaactgaagaatcacaaaagaagtgaatatgccttgccccaccttaactgatgacattccaccacaaaagaagtgtaaatggccggtccttgccttaagtgatgacattaccttgtgaaagtctttttcctggctcatcctggctcaaaaatcacccctgctgagcaccctgcgacccccactcctgccagccagagaacaacacccctttgactgtaattttcctttacctacccaaatcctataaaacggccccacccttatctcccttccttgactctctttttggactcagcccacctgcacccaggtgattaaaagctttattgctcacacaaagcctgtttggtggtctcttcacagggaagcgcatgaaagtggtgtttacctgtagtcctagctacttagaaggctaaggtgggaggatcccttgagaccaggagtttgagattacagtgagctatgatcatgaagtggtgatgattatagctgctcatgtgtgtccacatttgaaggctatcacttcaattaatcatatatgttttattttactaattattttatagtcctgataatattactgagtcaaaattgtataaacaatcacagggaaaaaataagattttttgttttttaagtgtattattcccattaaaagcatttcctagagccctagagctgtatatatttcactaaaatatgcccaatttcaagaaaaatattctgaattacttctactcggagtaatttgagatctctccttttcattgctgtctctgcactaaagcattttaaaagatgtgctttagtgattcgttttaaagctagacatacacatttgtggatgctattacaataaaaaccatgcagagtaactgagcctttggcattgactatttcacttcattacccatcaaatttgagacttcttccagaaaagcaagaggaaaatttaaatcaaattgatttataatagtgacaaatgaccttttttctccttaaacatttaatactaatatttgaaaggaaaagatggaggcatatgagggttttgatttgctgagagatgatggttttttgcattccttttgaaagcagggaaaatatacaggttattttcttttactgatttagattagcaggtatatgtcttttaccatctccatgctttggatgatggttatggatcatgccattaatgcatttaactgcccccaatacacagatctatctgattattgtaagcatcttgaggcatgggtttgcacccagaagtgctggtatacttataaaaaagaaaaaagaaacacacaatttgcttccacattgtgaaacacagtcaattttgaattaagttgctttattcagggttgcatactgatttgaagattcacttcattgtttctgctgctgtggttgtaacccaatgattacactgaattatctgaatacaaaagtaactgggtagaaactatattaatttcatgattatccacaaactttgcttttaattaactgttcatctgtttattcagcaaaagcttgttagtacataccatatgccagaaatggttaaagggagaaatgctacaacaaaaagtagatatgacataatttcttctctcaaaagcttttcagtaggagaaaggtgaatataaatgaaagccataaatccttgcatgtattataatatagaagtgtgttaatacacataacggacacctaaaacaggccatggtgatttatatttccagtttctaaaaggttttttaaagaatgtattcctaactgtaaataattttttttccaaaaactgtagtatatgttttaattttaaagtcatggccaggctgagcacagtggctcacacctgtaatcctagcattttgagaggccaaggtgggtggatctcaaggtcaggagttcaagatcagcctggccaatatggtgaaactccatctctactaaaaatataaaaattagccaggcatggtggtgggctcctgtagtcccagctactcaggaagctgaggcaggagaattgcttgaacctgggaggaggttgcagagagccaagatcacgccacttgcactctagcctgggcgacagagtgagactccgtctcaaaaaaaaaaaaaatcatggccatatatacttgtcaaactttcattttacttattcacatactacctgccaggcctctgagcccaagctaagccatcatatcccctgtgacctgcacgtacacatccagatggccggttcctgccttaactgatgacattccaccacaaaagaagtgaaaatggcctgttcctgccttaactgatgacaatgtcttgtgaaattccttctcctggctcatgctggctcaaaagctcccctactgagcaccttgtgacccccacacctgcccgccagagaacaacccccctttgactgtaattttcctttacctacccaaatcctataaaatggccccaccccatctccctttgctgactctctttttggatttagccagcctgcacccaggtgattgaaagccttattgctcacacaaagcctgtttggtggtctcttcacatcgacgctcatgaaatttggtgccaaaaccggggattgggggacctcccttaggagatcaatcccttatccttcctcctgctctttgctccatgagaaagatccacctatgacctctggtcctcagacccaccagcccaaggaacatctcaccaatttcaaatccggtaagcggcctcttcttactctgttctccaacctccctcactatccctcaacctctttatcctttcaatcttggtgccacacttcaatctctcccttctgttaatttcaattcctttcattttctggtagagacaaaagagacacgttttatccttggacccaaaactccggcgctggtcacggactgggaaggcagccttcccttggtgtttaatcattgcagggacacctctctgattattcgcccaggtttcagaggtgtcagaccacacagggacacctgccttgctccttcacccttagtggcaagtcctgcttttctaaggaagaggcaagaaccccaaccccttctctccatgtctctaccccttctctgcttttctgggggaggggtaagaacccctcaacccctgccccttcacccttagcagcaagtcccacttttctaggggagaggcaggaaccctgaccttttatctctgcaccccaatcccttatttccacaccccgacctcttgactctgcaccccgatcccttatttctatgccccgacctcttatatctgtgccccaaccccttatttccacaccccgacctcttatctctgtgccccaaccccttatttctgcaccctgacccctttcctgcttttctggaaggtaagaacccccgaaccccttcactccgtgtctctactctcttttctctgggcttgcctccttcactataggcaactttccaccctccattcttccttcttctcccttagcctgtgttcttaaaaacctaaaacctcttcaactcacacctgacctaaaacctaaatgccttattttcttctgcaatgctgcttgaccccaacacaaactcgacagtggttccaaatagccagaaaatggcactctcaatttttccatcctgcaagatctaaataattcttgtcataaaatgggcaaacagtctgaggtgcctgacatccaggcattcttttacacatcagtcccttcctagtctgtgcccaatgcaactcgtcccaatcttccttctttccctcccaccggtcccctcagtcccaaccccaagtgtcgctgagtctttctaatcttccttttctagagacccatgggacctctcccctcctcgccaggccaagctaggtcccaattcttcctcatcctctgctcctccaccctataatccttttatcacctcccctcctcacacctggtccagcttacagtttccttccgtgactagccctcccccacctgcccagcaatttcctcttaaaaaggtggctagagctaaaggcatagtcaaggttaatggtcctttttctttatccaacctttcccaaattagatagtgtttaggctctttttcatcaaatataaaaacacagcccagttcatggttcatttggcagcagccctgagacgccttacagccctagaccctaaaaggtcaaaaggccgtcttattctcaatatacattttattatccaatctgctcctgacattaaataaaactccaaaaattaaattctggccctcaaaccccacaacaggacttaattaacctcaccttcaaggtgcacaataatagagtagaggcagccaagtagcaatgtatttctaagttgcaattccttgcctccactgtgagacaaaccccagccacatctccagcacacaagaactccaaatgcctgaaccacagctgcaaggggttcctccagaacctcctcccccaagagcttgctacaagtgccagaaatctggccactgggccaaggaatgcccacagccccggattcctcctaagccaagtcccatctgtgtgggaccccactgaaaatcagactgttcaactcacctggcagccactcccagagcccttggaactctggcccaaggctctctgattccttctcagatcttctcggcttagcagctgaagactgacactggccgattgcctccgaaacctacaggaccatcacagatgctctgggtaactctcacagtggaaggtaagtccatccccttcttagtcaatatggagtctacccactccacattaccttcttttcaagggcctatttcccttgcctccataactgttgtaggtattgacggccaggcttctaaatctcttaaaactccccaactctggtgccaacttagacaacattcttttatgcaatcttttttagttatccccacctgcccagttcccttattagctacagccacacctcattgctgcccttttccccagttcaaagcctcctttgcatcctcctctcgtatcccccccctcgtatcctcccactttatcccacaagtataagatacctctactcactccttggtgactgatcatgcaccccttacaatctcattaaaacctaatcactcttaccccactcaatgccaatatcccatcccacagcacgctttaaaaagattaaagcctgttatcactcgcctgctacagcatggccttttaaagcctataaactctccttacaattcccccattttacctgtcctaaaaccagacaagacttacaggttagttcaggatctgcaccttatcaaccaaattgttttgcctatccaccctgtggtgccaaacccatatactctcctatcctcaatacctccctctacaacccattattctgttctggatctcaaacatgctttctttactattcctttgcacccttcatcccagcctctccgctttcacttggactgaccctgacacccatttggctcagcaaattacctaggctgtactgccacaaggcttcacagacagcccccattacttcaatcaagcccaaatttcatcctcatctgttacctatctcggcataattctcataaaaacacacgtgctctccctgctgatcatgtctgactaatctcccaaaccccaaccccttctacaaaacaacaactcctttccttcctaggcatggttagaaactttcacctttggatacctggttttgccatcctaacaaaaccattatataaactcacaaaaggaaacctagctgaccccacagatcttaaatcctttccccactcctctttccattccttgaggacagctttagagactgccccgacgctagctctccctgactcatcccaacccttttcattacacacagccaaagtgcagggctgtgcagtcggaattcttacacaaggaccgggatcgtgtcctgtagcctttttgtccaaacaacttgaccttactgttttaggctggccatcatgtctctgtgcagcggctgctgccaccctaatatttttagaggccctcaaaatcacaaactatgctcaactcactctttacagctctcataatttccaaaatctattttcttcctcacacctgatgcatatactttctgctccctggctccttcaactgtactcactctttgttgagtctcccacaattaccattgttcctggcctggacttaaatccggcctcctacattattccggataccacacctgaccctcatgactgcatgtctctgatccacctgacgttcaccctatttccccacatttccttcttccctgtttctcaccctgatcacacttggtttattgatggcagttccaccaggcctaatcgccactcaccagcaaaggcaggctatgcaatagtatcttccacatctgttattgaggctaccactctgcccccctccactacctctcagcaagccgaactagttgccttaactcaagccctcactcttgcgaaaggacaatgcgtcaatatttatactgactctaaatatgccttccatattctgcaccaccatgtggtcgtataggctgaaagaagtttcctcactacacaagggtcctccatcattaatgcctctttaataaaaagtctgctcaaggccgctttacttccaaaggaagctggggtcattcactgcaaaaggcatcaaaaggcatcagatcccattgctctaggcaatgcttttgatgataaggtggctagacaagcagctagctttccaacttctgtctctcacagcaaggcttatgctgataaggtggctagacaagaagctagctctccaacttctgtccctcacggccagtttttctccttcacatcggttactcccacctactctcccgctggaacttccacctatcaatctcttcccacacaaggcaaatggttcttagaccaaggaaaatatctccttccagcctcacgggcccattctattctgtcatcatttcataacctcttccatgtaggttacaagccgctagcccgtctcttagaacctctcatttcctttccatcatgaaagtctatcctcaaggagatcacttctcagtgttccatctgctattctactactcctcagggattgttcaggccccctcccttccctacacattaagctcggggatttgtccctgcccgggactggcagattgactttactcacatgccctgagtcagaaaactaaaatatctcttagtctgggtagacactttcactggatgggtagaggcctttcccacagggtctgagaaggacaccatggtaatttcttcccttctgtcagacataattcctcggtttagccttcccacctctatacagtctgataatggaccagcctttactagtcaaatcacgcaagcagtttctcaggctcttggtattcagtggaaccttcatatcccttacagtcctcagtcttcaggaaaggtagaacggactaatggtcctttaaaaacacacctcaccaagctcagccaccaatttaaaaaggactagacaatacttttaccactttcccttctcagaattcaggcctgtcctcagaatgctacaaggtacagtccatttgagctcctgtttagatgctcctttttattaggccccagtctcattccagacaccataccaacttagactgtgccccaaaaaacttgtcatccctactatcttctgtctagtcatactcctattcaccattctcaactacttatacatgcgctgctcttgtttacactgccggtttacactgtttttccaagccatcacagctgatacctcctggtgctatccccaaactgccactcttaactgttaaagtaaataaataatctttgctggcaggactatgctgaatctccttaagcactctctaattagatgtcctgggtcctcccaattcttagacctttaatacctgcttttctccttctcttattccgtttagtttttcaattcacacaaaaccatatccagtccaccaccaataattctatacgacaaatgtttcttctaacaaccccacaatatcaccccttaccacaaaatcttccttcagcttaatctctcccactctaggttcccacgccgcccctaatcccactcgaagcagccctgagaaacattgcccattatctctccataccacccccaaaaattttcaccgtcccaacactttaccactattttgttttatttttcttattaatataagaagacaggaatgtcaggcctctgagcccaagctaagccatcatatcccctgtgacctgcacgtacacatccagatggccggttcctgccttaactgatgacattccaccacaaaagaagtgaaaatggcctgttcctgccttaactgatgactttgtcttgtgaaattccttctcctggatcatcctggctcaaaagctcccctactgagcaccttgtgacccccacacctgcccgccagagaacaacccccctttgactgtaattttcctttacctacccaaatcctataaaatggccccacccctttctcccttcactgactctctttttggattcagccaccctgcacccaggtgattaaaagctttattgctctcacaaagcctgtttggtggtctcttcacatggaagtgcatgaaa

SEQ ID NO: 76 - DNA, 450 bp, Homo sapiens
gtcaggcctctgagcccaagccaagccatcgcatcccctgtgacttgcacttatacgcccagatggcctgaagtaactgaagaatcacaaaagaagtgaaaatgccctgccccgccttaactgatgacattccaccacaaaagaagtgtaaatggccagtccttgccttaagtgatgacattaccttgtgaaagtccttttcctggctcatcctggctcaaaaagctcccccactgagcaccttgtgacccccactcccatccgctagagaacaaacctcctttgactgtaattttcctttacctacccaaatcttataaaatggccccacccctatctcccttctctgactctcttttcggactcagcccacctgcacccaggtggttaaaagctttattgctcacacaaagcctatttggtggtctcttcacatggacgcgcatgaaa

SEQ ID NO: 77 - DNA, 5868 bp, Homo sapiens
gtcaggcctctgagcccaagccaagccatcgcatcccctgtgacttgcacatatacgcccagatggcctgaagtaactgaagaatcacaaaagtgaatatgccctgccccaccttaactgatgacattctaccacaaaagaagtgtaaatggccactccttgccttaagtgatgacattaccttgtgaaagtccttttcctggctcatcctggctcaaaaagcacccccactgagcaccttgcgacccccactcctacctgacagagaacaaaccccctttgactgtaattttcctttacctacccaaatcctataaaacggccccacccttatctccctttgctgactcttttcagactcagcctgcctgcacccaggtgaaataaacagccttgttgctcacacaaagcctgtttggtggtctcttcacacagacgcgcatgaaatttggtgccgtgactcggatcaggggacctcccttaggagatcaatcccctgtcatgttctttgctccgtgagaaagatccacctacaacctcaggtcctaagaccgaccagcccaagaaacatctcaccaatttcaaatccggtaagcggcctctttttactctcttctccaacctccctcactatccctcgacctctttctcctttcaatcttggtgccacacttcaatctctcccttctcttaatttcaattcctttcattttctgggagagacaaaggagacacgttttatccgtggacccaaaactccggtgccagtcacagactgggaaggcagccttcccttgacctttaatcattgcagggatgcctctctgattattcacccacgtttcaaaggtgttagaccacgcagggatgcctgccttggtccttcacccttagcggcaagtcccgcttttctggggaaggggcaagtaccccaacccctcctctccttgtctctaccccttctctgcttttctgggggaggggcaagtacccctcaaccccttctccttcactcttagcagcaagtcctgcttttctagaggaggggcaagtaccccaacctcgtatctctgtgccccaatcccttatttccgtgccccaacctcttatatctctgtgccccaatcccttatttctgtgccctaacttaactctgcgccccaatcctttatttccgtgccccgaccccttatttccgtgccccaccccttatttccatgccctgaccccttatttctgcaccccatcccttatttccacgccctgacctcttatctctgcgccccaaccccttttctggaaggtaagaaccccgaaccccttccctccgtttctctgctctctcttttctctaggcttgcttccttcactataggcaaccttccaccctccattcctccttctactcccttggcctgtgttctcaaaaacttaaaacctcttcaactcacaccttacctaaaacctaaatgtcttattttcttctgcaatgccacttgaccccaatacaaactctacagtagttccaaatagccagaaaatggcactttgaatttttccatcctacaagatctaaataattcttgttgtaaaataggcaaatggtctgaggtgcctgacgtccaggcattcttttacacatcagtcccttcctagtctgtgcccagtgcaactcgtcccaaatcttccttctttccctcccgcctgtcccctcagtcccaacaccaagcgtcgctgagtctttctaatcttccttttctacagacccatctgacctctcccttcctccccaggctactccctgccaggccgagctaggtcccaattcttcctcagcctctgctactccaccctataatctttttatcacctcccctcctcacacctggtctggcttacagtttagttctgtgactagccctccccctcctgcccagcaatttactcttaaaaaggtggctggagctaaagccatagtcaaggttaatgctcatttttctttatcccaaatcagatagcgtttaggctctttttcatcaaatataaaaatccagcccagttcatgacttgtttggcaacaaccctgagacactttacagccctagaccctaaaaggtcaaaaggccgtcttattctcaaaatacattttattacccaatctgctcctgacattaaatataactccaaaaattaaattctggccctcaaaccccacaacaggatttaattaacctcgccttcaaggtgtacaataatagaaaaaagttgcaattccttgcctccactgtgagacaaaccccagccccatctccagcacacaagaacttccaaacgcctgaaccgcagtggccaggcgttcctccagaacctcctcccacaggagcttgctacacgtgccggaaatctggccactgggccaaggaatgcccgcagcccgggattcctcctaagccccgtcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacggacgctgagcttcaggtaactctaacagtggaaggtaagcccgtccccttcttaatcaatacggaggctacccactccacattaccctcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactaactaaattatctgcttccctgactattcctggactacagctgtatctcattgccacccttcttcccaatccaaagcctcctttgcgtccccctcttgtatccccccaccttaacccacaagtataagatacctctactcccttcttggcaaccgatcatgcaccccttaccatctcattaaaacctaatcacccttaccccactcaacgccaatatcccatcccgcagcatgctttaaaaagattaaagcctgttatcactcgcctgctacagcatggccttttaaagcctataaactctccttaaaattcccccattttacctgtcctgaaaccagacaagccttacaagttagttcaggatctgcatcttatcaaccaaattgttttgcctttccaccccatggtgccaaacccatatactctcatatcctcagtacctgcctctacaacccattattctgttctagatctcaaacatgctttctttactatccctttgcacccttcatcccagcctttcttcgctttcacttggactgaccctgacacccatcaagctcagcaaattacctaggctgtactgccacaaagcttctcagacagcccccattacttcaatcaagcccaaatttcttcctcatctgttacctatctcggcataattctcataaaaacacacgtgctctccctgccaatctgtctgactgatctctcaaacccaagcaccttctacaaaacaacaactcctttccttcctaagcacggttagcgcagtcagaattcttacacaagagccaggaccacatcctgtagcccttctgtccaaacaacttgaccttactgttttagcctagccctcatgtctgcgtgcagcggctgctgctgctttaatacttttagaggccctcaaaatcacaaactatgctcaactcactctctacagttctcataacttccaaaatccattttcttcctcatacctgacgcatatactttctgcttcccggcgccttcagctgtactcactctttgttgagtctcccacaattaccgttgttcctggcccagactccaatccggcctctcgcattattctggataccacacctgacccccatgactgtatctctctgatccacctgacattcaccccatttccccaaatttccttctttcctgttccttaccctgatcacgcttgatttattgatggcagttccaccaggcctaatcgccacacaccagcaaaggcaggctatgctatagtacaagccactagcctgcctcttagaacctctcatttcctttccatcgtggaaatctatcctcaaggaaataacttctcagtgttacatctgctattctactactcctcagggattattcaggccccctcccttccctacacatcaagctcgaggatttgctcccacccaagactggcaaattagctttactcaacatgccccgagtcagataactaaaatacctcttagtctaggtagacactttcactggataggtagagtcctttcctacagggtctgagaaggccactgcagtcatttcttcccttctgtcagacataattcctcagtttagccttcccacctcaatacagtctgacaacagacaagcctttattagtcaaatcagccagcagtttttcaggctcttagtattcagtgaaacctttatatcccttacggtcctccatcttcaagaaaagtagaatagactaaaggtcttttaaaaacacacctcaccaagctcagccaccaacttaaaaaggactggacaatacttttaccactttcctttctcagaattcaggcctgtcctcggaatgctacagggtacagcccatttaagctcccgtacagacgctccttattaggccccagtctcattcgagacaccagaccaacttagactgtgccccagaaaacctgtcatccctactatcttctgtctactcatactcctattcaccgttctcaactactcatacatgccctgctcttgtttacactgccagtttacactgtttttccaagccatcacagctgatatctcctggtgctgtccccaaactgccactcttaactcttgaagtaaataaataatctttgctggcaggactatgctgaatctccttaggcgctctctaatcagatatcctgagtcgtcccaattcttagaccttttatacctgtttttctccttctgttattccatttagtttctcaattcatccaaaaccgtatctaggccatcaccaatcattctacacgacaaatgtttcttctaacaaccccacaatatcaccccttaccacaagacctcccttcagcttaatctctcccactctaggttcccacgccgcccctaatcccgcttgaagcagccctgagaaacatcgcccattctctctccatatcaccccccaaaaatttttgctgccccaacacttcaacactattttgttttatttttcttattaatataagaagtcaggaatgtcaggcctctgagcccaagccaagccatcgcgtcccctgtgacttgcacatatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaagcacccccactgagcaccttgcgacccccactcctgcccgccagagaacaaacccccttggactgtaattttcctttacctacccaaatcctataaaatggccccacccttatctccctttgctgattctcttttcggactcagcccacctgcacccaggtgaaataaacagccatgttgctcacacaaagcccgtttggtggtctcttcacacggacgtgcatgaaa

SEQ ID NO: 78 - DNA, 121 bp, Homo sapiens
aagacagctttaaagattgcccccatgctagctctccctgactgatcccaacccttttcattacacacagccgaagtgcagggctgtgcagtcagaattcttacacaagaaccgggaccgc

SEQ ID NO: 79 - DNA, 1161 bp, Homo sapiens
aaaagggcattcctaacttctgagggaacacctatcaatcatcagaaagccattaggagattattattggctgtacagaaacctaaagaggtggcagtcttacactgctggggtcatcagaagggaaaggaaagagaaatagaagggaaccaccaagcggatattgaagccaaaagagccgcaaggcaggaccctccattagaaatgcttatagaaggacctctagtatggggtaatcccctctgggaaaccaagccccagtactcagcaggagaaatagaatggggaacctcacgaggacatagtttcctcccctcaggatggctagccaccgaaggaaaaatacttttgcctgcagctaaccaatggaaattacttaaaacccttcaccaaacctttcacttaggcattgataacacccatcagatggccaaattattatttactggaccaagctttttcaaaaatatcaagcagatagtcagggcctgtgaagtgtgccaaaaacataatcccctgcactgcaggctatacatttcaatccctgtatctttaacctccttgttaagtttgtctcttccagaatcgaagctgtaaaactacaaatagttcttcaaatggagccccagatgcagtccatgactaagattcactgtggacccctggaccggcctgctagcccatgctccgatgttgatgacatcaaaggcacccctcctgaggaactctcaactgcacgacccctactatgccccaattcagcaggaagcagttagagtggtcattggccaacctccccaacagcacttgggttttcctgttgagagtggggactgagagacaggactagctggatttcctaggctgactaagaaaatccctaagcctagctgggaaggtgacggcatccacctttaaacacggggcttgcaacttagctcacacccgaccaatcagggagtaaagacagctcactaaaatgctaattaggctaaaacaggaggtaaagaaatagccaatcatctatcgcctgagagcacgagggagggacaatgatcaggatataaacccaggcattcaagccggcaatggctacccgctttgggtcccctctgtttgtatgggagctctgttttcactctattaaatcttgcaactgca

SEQ ID NO: 80 - DNA, 5596 bp, Homo sapiens
gtcaggcctctgagcccaagctaagccatcatatcccctgtgacctgcacgtacacatccatatggctggttcctgccttaactgatgacattccaccacaaaagaagtgaaaatggcctgttactgccttaactgatgacattgtcttgtgaaattccttctcctggctcatcctggctcaaaagctcccctacagagcaccttgtgacccccactctgcccgccagagaacaaccccgctttgactgtaattttcctttacctacccaaatcctataaaacggccccaccccatcccccttcgctgactctcttgtcggactcagcccacctgcacccaggtgattaaaagctttattgctcacacaaagcctgtttggtggtctcttcacatggacgcacatgaaatttggtgccgtgacttggatcgggggacctcccttgggagatcaatcccctgtcttgctctttgctctgtgaaaaagatccacctacgacctcaggtcctcagacccaccagcccaaggaacatctcaccaagtttaaattgggtaagcgacctcttcttactctcttctccaacctctctcactgtccctcaaccactttctcctttccactcttcaatctctcccttctcttaatttcaattcctttcattttctggtagagacaaaggagacacgttttatctgtggacccaaaactccggcgccggtcacggactagggaaggcagccttcccttggcgtttaatcattgcagggacgcctctctgattatatacccacgcttcagaggtgtcagatcacgcagggatgcctgccttggtccttcacccttagtggcaagtcccacttttctggggaaggggcaagttccccaacccctcctctccatgtctctaccccttctccacctttctggggggcaagaaacccccaaccccttctccttcactcttagcggcaagtcccgcttttctagaggggcaagtaccccaacctcgtatctctgcaccctgatcccttatttccatgccccaacctcttatctctgtgccccaaccccttatatccatgccccaacccctttcccgcttttctggaaggtaagaactcccgaaccccttccctccgtgtctctactctctcttttctctaggcttgcctccttcactatgggcaaccttccaccctccattcctcctccttctctcccttggcctgtgttctcaaaaacttaaaacctcttcaactcacacctgacctaaaacctaaatgccttattttcttctgcaatgccgcttgaccccaatacaaactggacagcagttccaaatagccagaaaacagcactttcaatttttccatcctgcaagatctaaataattcttgtcgtaaaatgggcaaacggtctgaggtgcctgacgtccaggcattcttttacacatcagtcccttcctagtctctgtgcccagtgcaactcgtcccaaatcttccttctttccctcctgcctgtcccctcagtctcaaccccaagcgtcgctgagtctttctaatcttccttttctacagacccgtctgacctctccctcctccccaggctgagctaggtcccaattcttcctcagcctccgctcctccaccgtattatctttttatcacctcccctccccacacctggtccagcttacagtttcgttcagtgactagccctcttccacctgcccagcaatttactcttagaaaggtggctggagctaaaggcatagtcaaggttaatgctcctttttctttatcccaaatcagatagtgtttaggctctttttcatcaaatataaaaatccagcccaattcatggctcgttcgccagcaaccctgagaagctttacagccctagacccttaaaagtcaaaaggccgtcttattcttaatacacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaagggaactgaaccgcagcggccaggcgttcctccagaacctcctcccccaggagcttgctacaagtgccagaaatctgaccaccaggccaaggaatgcctgcagcccaggattcctcctaagccgtgtcccatctgtgcgggaccccactggaaatcggactgttcaactcacctggcagccactcccagagcccctggaactctggcccaaggctctctgactccttctcggcttagcggctgaagactgatgctgcccaatcgcctcggaagctctgtagaccatcacggatgccgagcttcgggtaacactcacggtggaaggtaagtccgtcgccttagtcaatacggaggctacccactccacattaccttcttttcaagggcctgtttctcttgcctccataactgttgtgggtattgacggccaggcttctaaacccctgaaaactcccccactctggtgccaacttggacaacactcttttatgcactcttttttagttatccccacctgcccagttcccttattaggccgagatattttaaccaaattatctgcttccctgactattcctggactacagccgcatctcattgccacccttctcctcaacccaaagcctccttcgcgtcttcctctcctattcccccaccttaacccacaagtatgggacatctctactccttccctggcaactgatcacatacccgttaccatcccattaaaacctaatcacccttaccctgctcaatgccaatatcccatcccacagcacactttaaaaggattaaagcctgttatcactcgcctgctatagcatgggcttctaaaacctataaactctccttacaattcccccattttacctgtccaaaaaccggaaaagtcttacagattagttcaggatctgcgccttatcaaattgttttgcctatgcaccctgtggtgcccaacccctacactcttttgtcctcaataccttcctccacaactcactattccatgcttgatcttaaagatgcttttttcactattcccctgcacccctcgtcccagcctctcttcgctttcacttggactgaccctgacacccattaggctcagcaaattacctgggctgtactgctgcaaggtttcacagacagcccccattacttcagtcaagcccaaagttcatcctcatctgttacctatctcggcataattctcataaaaacacacgtgctctccctgctgatcgtgtctgactgatctctcaagccccagcaccttctacaaaacaacaactcctttccttcctaggcatggttagcgcggtcagaactcttacacaagagccaggaccacaccctgtagcctttctgtccaaacaacttgaccttactgttttagcctagccctcatatctgcgtgctgtggctgccgctgctttaatacttttagaggccctcaaaatcacaaactatgctcaactcactctctacagctctcataatttccaaaatctattttcttactcacacctgatgcatatactttctgctccctggctccttcagctgtactcactctttgttaagtcccacaattaccattgttcctggcccggacttcaatctggcctcccacattattccagataccacacctgacccccatgactgcatctctctgatccacctgacgttcaccccatttccccacatttccttcttccctgtttctcaccctgatcacacttagtttattgatggcggttccaccaggcctaatcgccacacaccagcaaaggcaggctatgctatggtacaagccactagccagcctcttagaacctctcatttcctttccattgtggaaatctatcctcaaagaaatcacttctcagtgttgcatcagctattctactactcctcatggattattcaggccccctcccttccctacacatcaagctcaaggatttgcccccgcccaggactggcaaattagctttactcaacatgccccgagtaagataactaaaatacctcttagtctaggtagacactttcactgggtaagtacagtcctttcctacagggtctgagaaggccaccgcagtcatttcttcccttctgtcagacataattcttcagtttagccttgtcattcccttctgtcagacaaaattcctcagttcagccttcccacctctatacagtctgctaacagaccagcctttattagtcaaatcagccaagcattttttcaggctcttagtattcagtgacagactaatggtctattaaaaacacacctcaccaagctcagccaccaacttaaaaaggactggacaatacttttaccattttcgcttccagaattcaggcctgtccttggaatgctacaagatacagcccatttaagctcctgtgtagacactcctttttattaggccccagtctcattccagacaccagaccaacttagattgtgccccaaaaaacttgtcatccctactatcttctgtctagtcatactcctattcaccgttctcaactactcacacatgccctgctcttgtttacactgccagtttacactgtttctccaagccagcacagctggtatctcctggtactatccccataccgccactgttaactcttaaaataaataaataatctttgctggcaaggctatgctgaacctccttaggcactttctaattagatgtcctgagtcgtcccaattcttagacctttaatacctgtttttctcctttccttattccctttagtttttcaattcatacaaaactgtatccaggccatcaccaataattctaaatgacaaatgtttcttttaacaatcccacaatgtcaccccttaccacaaaatcttccttcagcttaatcgctcccactttaggttcccacgccgcccctaatcctgctcaaagcagccttgagaaacatcacccattatctctccataccacccccaaaaatttttgctgtcccaacactttacccctatttcattttatttttcttattaatataagaagacaggaatgtcaggcctctgagcccaagctaagccatcatatcccctgtgacctgcacgtacacatccagatggccggttcgtgccttaactgatgacattccaccacaaaagaagcgaaaatggcctgttcctgccttaactgatgacattgtcttgtgaaattccttctcctggctcatcctggctcaaaagctcccctactgagcaccttatgaccccgactctgcccgccagagaacaacccccctttgactgtaattttcctttacctacccacatcctataaaacggccccacccctatcccccttcgctgactctcttgtcagactcagcccacctgcacccaggtgattaaaagctttattgctcacacaaagcctgtttggtggtctcttcacacggacgtgcatgaaa

SEQ ID NO: 81 - DNA, 5676 bp, Homo sapiens
gccaggcctctgagcccaagctaagccatcatatcccctgtgacctgcatgtacacatccagatggccagttcctgccttaactgatgacattatcttgtgaaattccttctccttgctcatcctggctcaaaagctccccttctgagcaccttgcgacccccaactcctgcctgccagagaacaacccccctttttcctttaccttcccaaatcatataaaatggccccaccccatctcccttcactcactcttttcggactcagcccacatgcacccaggtgaaataaacagctttattgctcaaacaaaccctgtttggtggtctcttcacacacacccatgtgaaatttggtgctgtgactcggatgcgggggggacctcccttgggagatcaatcccctgtcctcctgctctttgctctgtgagaaagatccacctacgacctcaggtcctcagactgaccagcccaagaaacatctcaccaatttcaaatccagtaagcggcttctttttactctcttctccaacctccctcactatccctcaacctctttctcctttcaatcttggcgccacacttcaatctctcccttctcttaatttcaattcctttcattttctggtagagacaaaggagacacgttttatccgtggagccaaaattccggcctggtgtcagaccacgcagggacgcctgccttggtccttcacccttagtggcaagtcccgcttttctgggggagggacaggagaccctcttatctctgtgccctgatcccttatttccgtgccccaaactcttatctctgtgccccgatcctttatttccatgccccgaactcttatctctgtgaccctatcccttatttccgtgaccggacctcttatctctgcaccccaaccccttatttctgtgctctgacctcttagctctgcactacaaccctttatttctgcaccccaacccctttctcgcttttctggaaggcaagaacccccccaccccttatctctgtgtctctactctctcttttccctaggcttgcctccttcactatgggcaagtttctgccctccattcccccttcttctcccttagcctgtgttcttaaaaacctaaaacctcttcaactcacacctgacctaaaacctaaatgccttattttcttccacaatgcctcttgaccccaatacaaactcgacagtagttccaaatagccagaaaatgagactttcaatttttccatcctacaagatctagacatttcttgtagtaaaatgggcaaacggtctgaggggactgacgtccaggcattcttttacacgtcggtccctccctagtctgttcctagtgcaactcatcccaaatcttccttctttccatcccacctgtcccctcagtcccaacctcaagcgtcactgagtctttctaatcttccttttctgaagactaatctgacctctcccctcctcgccaggctgagctaggccccaatgcttcctcagcctccactcctccaccctataatccttttatcacctcccctcctcacaccagctccagcttacagtttagttccatgactagccctcctcgacctgcccagccatttcctcttaataaggtggctggagctaaaggcacagtcaaggttaatgctcctttttctttatcccaaatcagatagcatttaggctctttttcatcaaatataaaaatccaccccagttcatggctcgtttggcagcaaccctgagatgctttacagccctagaccctgaaaggtcaacaggccgtcttattctcaatctacattgtattacccaatctgctcccgacattaaataaagctctgaaaattagatactggccctcaaaccccacaacgggacttaattaacctcgccttcaaggtgtacaataatagagtagaggcagccaagaagcaacatatttctgagttgtaattctttgcctccactgtgagacaaaccccagccacatctccagcacacaagaacttccaaacgctgaaagcgcagtggccaggcgttcctccagaaccgcctcccccaggagcttgctacaagtgccagaaagctggccaccaggccaaggaatgcccacagcctgggattcctcctaagccatgtcccatctgtgcaggaccccactagaaattggactgttcaactcacctggcagccactcccagagcccctggaactctggcccaaggctctctgactgactccttcccagatcttcttggcttagcagctgaagactgacactgcctgatcgatcacttcggaagcctacaggaccatcacagacgctctacctaactctcacagtggagggtaagtccatccccttcttagtcaatacggaggctccccactccacattaccttcttttcaagggcctgtttcccttgcctccataactgttgtgggtattgacggccaggcttctaaacctcttaaaactccccaagtctggtgtcaacttagacaatactcttttaagcactccttttagttgtccccacctgcccagttcccttattaggccgagacactttaactaaattatctgcttccctgactattcctggactacagctacatctcattgccacccaccttaacccacaagtagaagatacctctactccctccttggcgaccgaccatgcaccccttaccatctcattaaaacctaatcacccttaccctgctcaatgccaatatcacatcccacagcatgctttgaaaggactaaagcctgttatcacttgcctgctacagcatggccttttaaagcctataaactctccttacaattcccccattttacctgtcctaaaaccagacaagccttacaagttagttcaggatctatgccttatcaaccaaattgttttgcctatccaccccaaggtgccaaacacatatactctcctatcctcaattcctccctccacaacccattattctgttctggatctcaagtatgctttctttactattcctttgcacccttcatcccagcctctcttcgctttcacttggactgaccctgacacccatcaggctcagcaaattacctgggctgtactgacgccaagcttcacagacagcccccattacttcagtcaagcccaaatttctcccttatctgttacctatctcagcataattctcataagaacacacgtgttctccctgacgatcgtgtccgactaatctctcaaaccccaaccccagctacagaacaacaactcctttccttcctgggcatggttggatacttttacctttagatacctggttttgccatcctaacaaaaccattatataaactcaaaacagtaaacctagctgaccccatagatcttaaatcctttccccacccctctttctgttccttgaagacagctttaaagactgcccccaccctagctctccctgactcatccccacccttttcattacacacaaccgaagtgcagcgctgtgcagtcgaaattcttacacaaggaccaggattgcctcctgtagcctttttgtccaaacaacttgaccttactgttttaggctggccattatgtctccatgcagtggctgctgctgccctaatacttttagaggcccttaaaatcacaaaccatgctcaactcactctctacagttctcataatttccaaaatctattttcttcctcacacctgatgcatatactttctgctccccggctccttcagctgtactcactctttgttaagtctcccataagtaccattgttcctggcccggacttcaatccggcctcccacattattcctgataccacgcctgaccctcatgactgtatctctctgatccacctgatgttctcgccatttccccacatttccttcttccctgtttctcatcctgatcacacttagtttattgatgtcagttccaccaggcctaatcgccacacaccagcaaaggcaggctatgctatagtacaagccactagcccgcctcttagaaactcttatttcctttccattgtggaaatctatcctcaaagaaataacttctcagtgttccatctgctattctactactcctcagggattattcaggccccctcccttctctacacatcaagctcagggatttgcccccacccaggactgacatattagctttactcaatgtgccccgagtcaggaaactaaaatacctcttggtctaggtagacactttcactggataggtagagtcctttcccacagggtctaagaaggccaccacggtcatttcttcccttctatcagacataattcctcagtttggccttcccacctctatacagtccaatagtagaccggcctttattagtcaaatcagccaagcattgtttcaggctcttagtattcagtgaaatctttatatcccttacagttctcagtcttcaggaaagtagaacagactaatggtcttttaaaaacacacctcaccaagctcagccaccaactaaaaaaggactgaacaatacttttagcactttcccttctcagaagtcaggcctgtccttggaatgctacaaggtacagcccatttgagctcctatatagacgctcctttttattaggccccagtctcattccagacaccagaccaacttggactgtgccccaaaaaacttgtcatccctactatcttctgtctagtcatactcctattcatcgttctcaacaactcatacatgtcctgctcttgttacactgctggtttacactgtttctccaagccatcacagctgatatctactgttactatccccaaaccgccactcttaactcttaaatacataatctttgctggcaaggctatgctgaacttccttaggcactctctaattagatgtcctaggtcctcccaattcttagtcctttaatacctgtttttctccttctcttattctgtttagtttttcaattcatacaaaactgtatccaggccatcaccaataattctaaatgacaaatgtttcttctaacaacccaacaatatcaccccttaccacaaaatcttccttcagcttaatctctcccactctaggttcccatgctgcccctaatcccgctcaaagcagccctgagaaacatcgcccattatctctccataccacccccaaaaattttcgccgtcccaacactttaccactatttcgttttatttttcttattaatataagaagacaggaacgtcaagcctctgagaccaagctaagccatcatatcccttgtgacctgcacgtacacatccagatgacaggttcctgccttaactgatgacattccaccacaaaatagatgaaaatggcctgttcctgccttaactgatgacattatcttgtgaaattccttatcctggctcatcctggctcaaaagctcccctactgagtatcttgtgacccccactcctgcctgccacagaacaacccctttttcctttgcctacccaaatcttataaaacagccccaccccatctcccttcgctgactctcttttttgggctcagcctgcctgcacccaggtgaaatacacagctttattgctcacacaaatcctgtttggtggtctcttcacacggatgcgcgtgaaa

SEQ ID NO: 82 - DNA, 5809 bp, Homo sapiens
gtcaggcctctgagcccaagccaagccatcgtatcccctgtgacctgcacctgtacgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcctggctcatcctggctccaaaagcacccccactgagcaccttgcgacccccactcctgcccactgagcaccttgcaacccccactcctacccgccagagaacaaacccccttggactgtaattttcctttacctacccaaatcctataaaacggcctcacccttatctcccttcactgacccttttcggactcagcctgcctgcacccaggtgaagtgagcaacagccatgttgctcacacaaagcctgtttggtggtctcttcacatggacgcgcatgaaatttggtgccgtgactcggatcgggggacctcccttgggagatcaatcccctgtcctcctgctctttgctccgtgagaaagatccacctacgacctcaggtcttcagaccgaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaagagacatgttttatccgtgaacccaaaactccggcgccagtcacggactgggaaggcagccttcccttggtatttaatcattgcagggacgcctctctgattatacactcacgtttcaagggtgtcagaccacgcagggacgcctgccttggtccttcacccttagcggcaagtcccgctttcctggggcaggggcaagtacccctcaaccccttctccttcacccttagcggcaagtcccgctttcctagggggcaagaaccccccaatcacttatttccacaccccaacctcttatctctgtgccccaatcgcgtatttccacaccccaacctcttatctctgcaccccaatcccttatttccgcaccctgacctcttatctctgtgccccaatcccttatttccgtgtcccagccctttctctgcttttctggaggggaagaaacccccaccccttctccgtgcctctactcttttctctgggcttgcctccttcactatgggcaagcttccaccttccattcctctttcttctcccttagcctgtattcttaagaacttaaaacctcttcaattctcacctgacctaaaatctaagagtcttattttcttctgcaatgccgcttgaccccaatacaaactcaagagtagttccaaatagccagaaaacggcactttcaatttttccaccctacaagatctaaataattcttgtcgtaaaatgggcaaatggtctgaggtgcctgaagtccaggcattcttttacacatcagttccttcctagcctctgtgcccagtgcaactcgtcccaaatcttccttctttccctccctcctgtcccctcagtaccgaccccaagcgtcgctgagtctttctaatcttccttttctacagacccatctgacctctcccctcctcgacaggccaagctaggccccaattcttcctcagcctccgctcctccaccctgtaatctttttattgcctcccctcctcacacctggtctggcttacagtttccttctgtgactagccctccccgacctgcccagcaatttactcttaaaaaggtggctggagccaaaggcatagtcaaggttaatgctcctttttctttatcccaaatcagatagcgtttaggctctttttcatcaaatataaaaatccagcccagttcatggctcgtttggcagcaaccctgagacactttacagccctagcccctaaaaggtcaaaaggccgtcttattctcaatatacattttattacccaatctgctcccgacattaaataaaactccaaaaactagaatctggccctcaaaccccacaacaggacttaattaacctcaccttcaaggtgtgcaataacagaaaaaagttgcaattccttgcctccactgtgagacaaacctcagccacatctccagcacacaagaacttccaaacgcctgaactgtagcagccaggcgttcctccagaacctcctcccccaggaacttgctacacatgccggaaatctggccactgggccaaggaacacccgcagcccaggattcctcctaagccacgtcccatctgtgtgggaccccactgaaaattggactgttcaactcacctggcagccactcccagagctcctggaactctggcccaaggctctctgactgactccttcttggcttaccggctgaagactgacactgcccgattgcctcggaagccccctagaccatcacggacgccgagcttcgggtaactctcacagtggaaggtaagcccgtccccttcttaatcaatacggaggctactcactccacattacgttcttttcaagggtctgtttcccttgcctccataactgttgtgggtattgatggccaggcttctaaacctcttaaaactccccatctggtgccaacttagacaatactcttttaagcactcctttttagttgtccccacctgcccagttcccttattaggctgagacactttaactaaattatctgcttccctgactattcctggactacagctatatctcattgctgctcttcttcccaatccaaagcctcctttgggtcctcctcttgtatcccccaaccttaacccacaagtataagatacctctactccctccttggcgaccaatcatgcaccccttaccatctcattaaaacctaatcacccttaccccactcaacgccaatatcccatcccacagcacactttaaaaagattaaagcctgttatcactcgcctgctacagcatggccttttaaagcctataaactctccttacaattcccccattttacctgtcctaaaaccagacaagccttacaagtttgttcaggatctgcgcctcatcaaccaaattgttttgcctatccaccccgtggtgccaaacccatatactctcctatcctcaatacctgcctctacaacccattattctgttctagatctcaaacatgctttctttgctattcctttgcacccttaatcccagcctctcttcgctttcacttggactgaccctgacacccatcaagctcatcaaattacctaggctgtactgccgcaaagcttcacagacagcccccattacttcaatcaagcccaaatttcttcctcatctgttacctatcttggcataattctcataaaaacacacgtgctctccctgccaatcgtgtccgactgatctctcaaacccaagcaccttctacaaaacaacaactcctttccttcctaggcatggttagcgaggtcagaattcttacacaagagccaggaccacaccctgtagcctttctgtccaaacaacttgaccttactgttttagcctagccctcatgtctgcatgcagctgctgccgctgcattaatacttttagaggccctcaaaatcacaaactatgctcaactcactctctacagttctcataacttccaaaatctattttcttcctcatacctgatgcatatactttctgcttcccggctccttcagctataccccactctttgttgagtctcccacaattaccgttgttcctggcccagacttcaatcctacctcccacattattcctgataccacacctgacccccatgactgtatctctctgatccacctgacattaaccccatttccccaaatttctttctttcctgttcctcaccctgatcacgcttgatttattgatggcagttccaccaggcctaatcgccacacaccagcaaaggcagatgatgctatagtacaagccactagcccgcctcttagaacctctcatttcctttccatcatggaaatctatcctcaaagaaataacttctcagtgttccatctgctattctgctcagtgttccatctgctattctactactcctcagggattattcaggccccctcccttccctacacatcaagctcgaggatttgccccacccaggactggcaaattagctttactcaacatgcccttagtcagataactaaaatacctcttagtctaggtagataatttcactggataggtagaggcctttcctacagggtgtgtacagggtgtgagaaggccaccgcagtcatttattcccttctgtcagacataattcctcagtttagccttcccacctcaatacagtctgataacagacgagcctttatcagtcaaatcagccaagcagtttttcaggctcttagtattcagtgaaacctttatatcccttacggtcctctgtcttcaagcaaagtagaatggactaaaggtcttttaaaaacacacctcaccaagctcagccaccaacttaaaaaggactggacaatacttttaccactttcccttctcagaattcaggcctgtcttcagaatgctacagggtacagcccatttaagctcctgtatagacgctcctttttattaggctccagtctcattccagacaccagaccaacttagactgtgccccaaaaaacctgtcatccctactatcttctgtctagtcatactcctattcaccgttctcaactactcatacatgccctgctcttgtttacactgctggtttacactgtttttccaagccatcacaactgatatctcctggtgctatccccaaactgccactcttaactcttgaagtaaatacataatctttgctggcaggactatgctgaatctccttaggcactctctaatcagatatcctgagtcgtcccaattcttagaccttttatacctgtttttctccttctgttattccatttagtttctcaattcatccaaaaccgtatccaggccatcaccaatcattctatacgacaaatgtttcttctaacatccccacaatatcaccccttaccacaagacctcccttcagcttaacctctcccactctaggttcccacgccgcccctaatcccgcttgaagcagccctgagaaacatcgaccattctctctccataccacccccaaaaaattttcaccgccccaacacttcaacactattttgttttatttttcttattaagaaggcaggaatgtcaggcctctgggcccaagccaagccatcacatcccctgtgacctgcacctataagcccagatggcctgaagtaactaaagaatcacaaaagaagtgaatatgccctgccccaccttaactgatgacattccaccacaaaagaagtgtaaatggccggtccttgccttaactgatgacattaccttgtgaaagtccttttcctggctcatcctggctccaaaagcatccccactgagcaccttgcgacccccactcctgcccactgagcaccttgcaacccccactcctacccgccagagaacaaacccccttggactgtaattttcctttacctacccaaatcctataaaacggccccacccttatctcccttcgctgactctcttttcgaactcagcccgcctgcaaccaggtgaaataaacagccatgttgctcacacaaagcctgtttggtggtctcttcacacggacgcacatgaaa

SEQ ID NO: 83 - DNA, 5648 bp, Homo sapiens
caggcctctgagcccaagctaagccatcatatcccctgtgacctgcacatacacatccagatggctggttcctgccttagctgatgacattccaccacagaagaagtgaaaatggcctgttcctgccttaactgatgacattatcttgtgaaattccttctcctggctcatcctggctcaaaagctcccctactgagcaccttgtgacccccactcctgcccatcagagaacaacccctttgactgtaattttcctttacctatccaaatcctataaaacggccccacccctatatctcccttttctgactctcttttcagactcagtccgcctgcacccaggtgaaataaacagccttgttgctcaaacaaagcctgtttggtggtctcttcacatggatgcacatgaaatttggtgccgtgtctcggatcgggggacatcccttgggagatcaatcccctgtcctcctgctttttgctccgtgagaaagatccacctacaacctcaggtcctcagaccgaccagtccaaggaacatctcaccaacttcaaatccagtaagtggcctctttttactctcttttccaacctctctcactatccctcaacctctttctcctttcaactgccacacttcaatctctcccttctcttaatttcaattcctttcattttctcgtagagacaaaggagacacattttatccgtggacccaaaactccggcaccagtcatgtactcagaagacagccttcccttagtgtttaatcattgtggggatgcctctctgattattcacccacattccattggtgtctgatctccgcagggatgcctgacttgatctttcacccatgttcccttggtggcaagtcaattgcggggacacctgctttggctgctcacccacgttgcagcccagggctgctccccacccccttctccatgtctctaccctcttctttaaacttgcctccttcactatgggcaaccttccaccctccattcctccttcttctcccttaacctgtgttcttaaaaacctaaaacctcttcaactcacacctgacctaaaacctaaatgccttattttcttttgcaatcctgcctgaccccagtacaaactcaacagtggttccaaatagccataaaatggcactttcaatttttccatcctacaagatctaaataattcttgtcgtaaaatgggcaaacggtctgaggtgcctgatgtccaggcattctttacacattggtccctccttagtctctgtgcccagtgcaactcctcccaaatcttccttctttccctcccacctgtcccctcagccccaaccccaagcgttgctgagtctttctaatcttccttttctacagacccatctgacctctcccctcctcaccaggccaagctaggtgccaattcttcctcagcctcccctcttccaccctataattcttttatcacctcccttcctcacacccagtccaccttacagttttgttctgtgactagccctcccccacctgcccagcaatttactcttaaaaaggtggctggagctaaaggcatagtcaaggttaatgctcctttttctttatcccaaaacagcgtttagactctttttcatcaaatgtaaaaacccagcccagttcatggctcatttggcagcaaccctgagatgctttacagccctagaccctaaaaggtcaaaaggccatcttattctcaatatacattacccaatctgctctcgacattaaataaaactccaaaaattaaattctggccctcaaaccccacaacaggacttaattaacctcaccttcaaggtgtacaataatagagtagaggcagccaagtagcagcgtatttttgagttgcaattccttgcctccactatgagacaaaccccagccacatctccggcacacaagaacttccaaacgcctaaaccgcagtggccaggcattcctccaggcctgcctcccctaggagcttgctacaagtgctagaaatctggccatcaggccaaggaatgcccgcagcctgggattcctcctaagccatgtcccatctgtacgggaccacactgaaaatcagactgttcaactcacctggcagccactcccagagcccctggaactctggcctaaggctttctgactgactccttcccagatcttctcagcttagcagctgaagactgacactgcccgatagccttggaagccccctagaccatcacggatgccgagctttaagtaactctcacagtggaaggtaagtccatccccttcttaatcaatacgaaggctacccacaccacatctccacattaccttcttttcaaaggactgtttcccttgcctccataactgttgtgggtattgatggccaggcttctaaacctcttaaagctccctaactctggtgccaagttagaaaatactcttttaagcactcctttttagttatcccagttcctttattaggccaagacactttaactaaattatccacttccctgagtattcctggactacagccacatctcattgccacccttcttcccaatccaaagcctcccttgtgtcctcccttttttatccccccaccttaacccacaaggataagatacctctactccctccttggcgactgatcacgcatcccttaccatctcattaaaacctaatcacccttaccctgctcaatgccaatctcccatcccacagcatgctttcaaaggattaaagcctgttatcactggcctgttacagcatgaccttttaaagcctataaattcttcttacaattcccccattttacccgtcctagaaccagacaagccttacaggttagttcaggatctgcaccttatcaacacaattgttttgcctattcaccccatggtgccaaacccatatactctcctatcctcaatacctccctccacaacccattattctgttctggatctcaaacatgctttctttactattcctttgcacccttcatcccagcctctctttgctttcacttggactgaccctgacacccatcagtctcagcaaattacctgggctgtactgccacaaagcttcacagacagcccccattacttcagtcaagccaaaatttcatcctcatctgttacctatctcagcataattctcagaaaaacacacgtgctctccctgccgatcatgtccagctgatccctcaaaccacaacaccttctgcaaaacaacaactcctttccttcctaggcatggttggatacttttgacttcagatacctggttttgccatcctaacaaaaccattatataaactcacaaaaagaaacctagctgacccaatagatcctaaatcctttccccactcctctttccattccttgaagacagttttagagactgcccccaccctagctctccctgactcatcccaactcttttcattatccacagccgaagtgcagggctgtgcagtcggaattcttacacaagaactgggaccgcaccccgtagcctttttatccaaacaacttgaccttactgtcttgcttagccctcaagtctgtgtgcagcaggtgccaccacaaccccaatacttttagaggcccttaaaatcacaaactatgctcaacttactctctgcagttctcataacttccaaaatctattttcttcctcactcctgacacatatactttctgctccctggctccttcagctgttctcactctttggtgagtctcccacaattaccattgttcctggcccagacttcagtctggtctcccacattattcctgataccacaactgacccccatgactgtatctctctgatccacctgacattcaccccatttccccatatttccttctttcctgttcctcaccctgatcacactttgtttattgatggcaattccagcaggcctaatggccacacaccagcaaaagcaggctatgctatggtacaagccactagcccgcctcttagaacctctcatttcctttccatcgtggaaatctatccgcaaggaaataacttctcagtgttccatctgctattctactactcctcagggattattcaggccccctcccttccctacacatcaagcttggagatttgcccccacccagcactggtaaattggctttactcagcatgccccaagtcagataactaaaatacctcttagtctaagcagacactttcgctggataagtagaggcctttcctacagggtctgagaaggccaccacagtcatttcttcccttctgtcagacataattcctcggtttgggcttcccatctctatacagtctgataacggaccagcctttattagtcaaatcagccaagcagtttttcaggctcttggtgttcattgaaacctttatatcccttacggtcctccgtcttcagaaaaagtagaacagactagaggtcttttaaaaacacacctcacgaagctcagccaccaacttaaaaaggactggacagtacttttaccactttcccttctcacaagtcaggcctgtcctcagagtgctacaaggtacagcccattcgagctcctgtatagatgctcctttttattaggccccagtctcatcccagacaccagaccaacttagactgcaccccaaaaaacttgtaatccctactattttctatctagtcatactcctattcactgttctcaactactcataaatgccctgctcttgtttacactgctggtttacactgtttctccaagctatcacagctgatatctcctggtgctatccccaaaccaccactcttaactcttagagtaaataaataatctttgctggcaaggctatgctgaacctccttaggcactctctaattagatgtcctaggtcctcccaattcttagtcctttaatacctgtttttctccttctcttattccgtttagtttttcaattcatacaaaaccgtatccaggccatcactaataattctacatgacaaatgtttcttttaacaaccccgcaatattgccctttaccacaaaatcttccttcagcttaatctctcccactctaggttcccatgccgcccctaatcctgctcaaagcagccctgagaaacatcacccattatctctccataccacccgcaaaaattttcactgtcccaacactttaccactatttcattttatttttcttattaatataagacaggaatgtcaggactctgagtccaagctaagcctgtgacctgcacgtacacatccagatggctggttcctgccttaactgatgacattccaccacaaaagaagtgaaaatggcctgttcctgccttaactgatgacattctcttgtgaaattccttctcctggctcattctggctcaaaagctcccctgctgagcaccttgtgacccccactcctgcccgccagagaataacccccctttgactgtaattttcctttacctacccaaatcctataaaatggccccacctctatctcccttctctgactctcttttcggactcagcccgcctgcacccaggtgaaataaacagccttgttgctcacagaaggcctgtttggtggtctcttcacacagacgtgcacgaaa

SEQ ID NO: 84 - DNA, 65 bp, Homo sapiens
ggtagttaggcagacatgagcagggcagggaaggctctcctccatccactaggaatgttggatga

SEQ ID NO: 85 - DNA, 7395 bp, Homo sapiens
cctctttgggtcccctccctttgtatgggagctctgttttcaatctattaaatcttgcaactgcacactcttctggtccatgtttgttactgctcaagctgagcttttctcaccatccaccactgctgtttgccactgttgcagacccaccactgacttccacccctccggatccagcagggcgtccgctgtgctcctgatccagcaaggcgcccattgccgctcctgattgggctaaaagcttgccattgttcctgcacggctaagtacctgggttcatcctaatcgagccgaacactagtcgctgggttccacggttctcttccatgacccacggcttctaatagagctataacactcactgcatggcccaaggttccattccttggaatccatgaggccaagaaccccgggtcagggaacaagaggcttgccgccatcttggaagcggcccgccaccatcttgggacctctgggagcaaggacctccccgtaacattttggcaaccacgaagggatctccaaagcactgagtaatattggaccacttttgcttgctattctgtcttatccttccttagaattggaggaaaatactgggcacctgttggccggttaaaaatgattagcgtggccgccagaattaagactcaggtgtgaggctgtctgggaaagggctttctaacaaccccccaacccttctgggttgggtatgttggtctgccttgaagcagcttccgctttcaattctcccggggaagcagagggccgactagaggtaaaaagctgtcgtcccaaactcccgatgttagctggttgagatcatggtgcagccagaagtctctactcaacagtcgcccatgcgttcacccctacctttccttctgacccataattcctggatccgaccatgacgttcttgaaagtgtagccccaaaattctccttacctctgaatctacttcctccgatccctgcctcctgggtactaatggttcagactttcatttcctctagcaagttgtatctccaaagggatctaaggaagctctacgctgagtccttaggcccctaggctatggacccagagaatcttgtctctggtgtctctcccaatttaggcatacagctctcgacatgggcagttatgtgggacccattcccttctacccttgccagggccccaagtttgtaaagggctaggagaaaagacagagaaacagagagagacagaggggagagacagaggggagagaaagagagagagagacaaagagggagtcaaagagagaaagagaaagatagaagtagtaaagaaaaaacagtgtgccctaatcctttaaaagccagggtaaatttaaaacctataattgataattgaaggtcttctccgtgaccctataatactccaatactaccttgttgtcagtgtaaacaagggtgtagcctgaaaacactgagaccactgaccacctgtagccttcctatcaaaaatccttaactcagtaaccaatggatggcccaaatgcgttcaatctgtagcagcaactgctttgctaacagaagaaagtagaaaaataacctttagaggaaacctcattgtgagcacacctcaccagttcagaattatcctaagtcaaaaaagcaaaaaggtagcttactaactaaaagcttaaagtatcgggctcttctgttagaaaaagttgatttaacgttaaccactgaaaattcccttaacccagcaaatttcctaacaggggatttaaatcttaattaccatacaaagatccgaccagacctaggaggaactcccttcaggacaggatgatagatggttcctcccaggtgattgaaaaaaaactcacaatgggtattcagtaactgatagggagactcttgtggaagcagagttaggagaattgcctaataatttttctgctcaaacgtgagagttgtttggactcagccaagccttaaagtacttacagaatcaaaaaactctatctcaatcctgactcaaaaggttacctacaccctctctgaagtgaatttgcataacaactgttgtttatgggaatgcatcttgatggggcaactgggttgctatgaaatattcaagaacccagcccagctctagaactcacctctgagcacaaaggcaatgtcgggtatgctggtaaaggaccactagaatccagcagcccgcacccctttctttgtggtcaagaaaggcgggaaaacaggtgcaggactgctacatcggtgagcgtaactaatccgacaagcagaagtccacgggtggttacgcaccctggaaaggaataaacattaggaccacagaggacgctctaggactaatgctcatcagaaaatgactagggctgctggcattcctatgttcttttttcagatgggaaacattccccctaaggcaaaaacgcccctaagatgtattctggagaattgggaccaatttgaccctcagatgctaagaaacgacttatattcttctgcagtaccgcctggtcagatatccgcttcaaggggggaagcctggcctcctgagggaagtataaattacaacaccatcttacagctagacctgttttgtagaaaagaaggcaaatggagtgaagtgctgtatgtacaaactttcttttcattaagagacaactcgcaattatgtaaaaagtgtgatttatgccctacaggaagccctcagagtctacctccctaccccagtggccccccaccccgactcctttcccaactaataagaatcccccttcaacccaaacggtccaaaaggagatagacaaaggggtaaacaacaaaccaaagagtaccaatattccccaattatgccccctccaagcagtggaaggaggagaattcagcccagccagaatgcatgtacctttttccttctcagacttgaagcaaattaaaatagacctaggtaaattctctgataaccctgatggctatattgatattttacgagggttaagacagtcctttgatctgacatggagagatataatgttactgctaaatcagacactagctccaaatgagagaagtgccgccataactgcagcctgagagtttggcgatctctggtatctcagccaggtcaatgataggatgacaacagaagaaagagaaaaattccccacaggccagcaggcagttctcagtgtagaccctcactgggatgcaaaatcagaacatggagattggtgcctcagacatttgctaacttgcgtgctagaaggactaaggaaaactaggaagaagcctatgaattattcaatgatgtccattataacacagagaaaggaagaaaatcctactgcctttctggagagactaagggaggcactgaggaagcatacctctctgtcacctgactctactgaaggccaactaatcctaaaggataagtgtatcactcagtcagctacagacattagaaaaaaacttcaaaagtccgccttaggcccggagcaaaacttagaaaccctattgcacttggcaaccttggttttttataatagagatcaggaggagcaggcggaatgggacaaacaggattaaaacaaaaggccaccactttagtcatgaccctcaggcaagcggactttggaggctctgggaaagggaaaagctgggcaaatcaaatgcctaatagggcttgcttccagtgtggtctacaaggacactttaaaaaagattgtccgaatagaaataatctgccccctcgtccatgccccttatgtcaagggaatcactggaaggcccactgtcccaggggacgaaggtcctctgagtcagaagccactaaccagatgatccagcagcaggacagagggtgcccggggcaagcaccagcccatgccatcaccctcacagagccctgggtatgcttgatcattgagggccaggaggttaactgtctcctggacactgaaccggccttctcagtcttactctcctgtcccggacaactgtcctccagatctgtcactatccaaggggtcctaggacagccagtcactagatacttctcccagccactaagttgtgactggggaaactttattcttttcacatgcttttctaattatgcctgaaagccccactcccttgttagggagagacattctagcaaaagcaggggccattatacacctgaatataggagaaggaacacccatttgttgtcccctgcttgaggaaggaattaatcctgaagtctgggcaacagaagggcaatgtggatgagcaaagaatgcccatcctgttcaagttaaataattccacctcctttccctaccaaaggcagtacccccttagacccgaggcccaacaaggactccaaaagattgttaaggacctaaaagcccaaggcctagtaaaaccatggaatacctcctgcaatactccagttttaggagtacagaaacccaatggacagtggaggttagtgcaagatctcaggattatcaatgaggccattgtccctctatacccagttgtacctaacccttatactctgctttcctaaataccagaggaagcagagtggtttacagtcctggaccttaaggatacctttttctgcatccctgtacatcctgactctcaattcttgtttgcctttgaagatccttcgaacctaatgtctcaactcacctggactgttttaccccaagggttcagggatagcccccatctatttggccaggcactagcccaagacttgagccagttctcatacctggacactcttgtccttcggtacatggatgatttatttttagctgcccgttcaaaaaccttgtgccatcaagccacccaagcgctcttaaatttcctcgctacctgtggccacaaggtttccaaaccaaaggctcagctctgctcacagcaggttaaatacttagggctaaaattatccaaaggcaccagggccctcagtgaggaacgtttccagcctatactggcttatcctcatcccaaaaccctaaagcaactaagagggttccttggcataacaggcttctgccgaatatggattcccaggcacagtgaaatagccaggccattatatacactaattatggaaactcagacaacctatacccatttagtaagatggacacctgaagcagaagcggctttccaggccctaacccaagccctagcattaagcttgccaatggggcaagacttttctttatatgtcacagaaaaaacaggaatagctctaggagtccttacacaggtccgagggaccagcttgcaacccatggcacacctgagtaaggaaattgatggagtggcaaagagttggcctcactgtttttgggtagtggcagcagtagcaatcttagtatccgaagcagttaaaataatacagggaagagatcttactgtgtggacatcgcatgatgtaaatgatatactcactgctaaaggagacttgtggctgtcagacaaccatttgcttaaatatcaggctctattacttgaagggccagtgctgcgactgtgcacttgtgcaactcttttttttttttttttgagacagaatctagctctgtcacccaggctggagcgcagtgacacgatcttggctcactgcaagctccgcctcccaggttcacgccattctcctgcctcagcctcccaagtagccgggactacacgcgcccgccaccatgcctggctaatttttcgtatttttagtagagacgggatttcaccgtgttagccaggatggtctagatctcctgaccttgtgatctgcctgcctttgcctcccaaagtgctgggattacaggcataagcgactgtgcgtggcctgcacttgtgcaactcttaacccaggaacatttcttccagacaatgaagaaaagatagaacataactgtcaacaggtgattgctcaaacctacaccactcgaggggaacttctagaggttcccttgactgatcctgacctcaacttgtatactgatgggagttcctttgtagaaaaaggacttggaaaagtggggtatgcagtggtcagtaataatggaatacttgaaagtaatcctctcactccaggaactagcgctcagctggcagaactaatagccctcactcgggcactagaattagaaggaaaaaaggtaagtatatatacagactctgagtatgcttacctagtcctccacgtccacgcagcaatatggagagaaagggaactcctaacttccgagggaacacctatcaaacatcaggaagccattaggaggttattattattggctgtatagaaacctaaagaggaggcagtcttacactgctggggtcatcagaaaggaaaggaaagggaaatagaagggaactgccaaaagagccacaaagtgggaccctccattagaaatgtttatagaaggacccctagtatggggtaatcccctctgggaaaccaagccccagtactcagcagaataaatagaatggggaacctcatgaggacgtagtttcctcccctcaggatggctagccaccgaagaaggaaaaatacttttgcctgcagctaaccaatggaaccttacttaaaacccttcaccaaacctttcacttaggcattgatagcacccatcagatggccaaatcattatttactggactaggtcttttcaaaactgtcaagcagatagtcagggcctgtgaagtgtgccaaagaaataatcccctacactgcaggccatacatttcaatgcctgtatctttaacctccttgttaagtttgcttcttccagaatcaaagctgtaaaactacaaatggttcttcaattggagccccagaagcagtccatgactaagatctactgcggacccctggaccagcctggagcccatgctctggtgttaatgacatcaaaggcatccctcccgaggaaatctcaactgcataacccctactatgccccaattcagcaggaagcagttagagtggatatcggccaacctccccaacagcacttgggttttcctgttgagaggggggactgacagacaggactagctggatttcctaggctgactaagtatccctaagcctagctgggaaggtgaccgtatccacctttaaacatggggcttgtaacttagctcacatccaaccaatcaggtagtaaagagagctcactaaaatgctaattaggcaaaaacaggaggttaagaaatagccaatcatctatcgtctgagggcatgggggagggacaatgatcgggatataaacccaggcattcaagccggcaacggctaccctctttgggtcccctccctttgtatgggagatctgttttcactctcttaaatcttgtaacggca

SEQ ID NO: 86 - DNA, 7438 bp, Homo sapiens
aactgaaagtaaatatgcttcttatctcagcttcattaaaattctcttaagaagagggggagttaaagtttctacagaaaatctagttacgctatttcaagcaatagaacaattctgcccatggtttccagaacagggaattttagatttaaaagattgggaaaaattggcaaagaactaaaacaagcaactagggaaggtaagatcatcccacttacagcatggaatgattgggccattattaaagcaactttagaaccatttcaaatagaagaagacagcgtttcagtctttgatgcccctgaaagctgtgtaatagattgtgaagaagaggcaggaacagactttaagaaaggaatggaaagttcacattgtaaaactgcagtagagcctgtaatggttcggtcaatgcaaaatgttgactataatcaattacaggaggtaatatatcctgaatcatcaaaattggggaaggaggtccagaattatttgggccatcagagtttagaccacgatggccaccaaccccttctcccgcggttcagatgcctgtgatgtcacaatctcaaatgccaatccaggcacagtatccgcaataccagcccgtagaaaataaacccaaccatcggtagtttatcaacaccagccgccagccgtatttcagtatccgccgtctccagaggttcagtatggatctcaggcggtgcgtcctgtgccaaatagcaaggcactatatcaacaacccacggcgatggcgtttgatcttacagtaccacctagtggacaagatagtgcactgcatgagaccattgctacagccagaaaacagggagatcttgaggcatggcaatatccgggaatgttacaaccgatgccggccgggaaagggagtcaagcaggagcgtctgtctgaactgagaccagatatgaatctttcaccacaaaaatgttaaaagatatgaaggaaggagttaaacaatatggacctaactctccttatatgagaacattattagattccattgctcatggaaatagacttattccttataattgggaaattttggctaaatcttccctttcaccctctcagtatctacagtttaaaacctggtggattgatggggtacaagaacaggtatgaaaaaatcaggctactaatcctgttgcttatatagatgcagaccaattactaggaacaggtccaaattggggcactattaaccaacaatcagtaatgcaaaatgaggctactgaacaactaagggctatttgcctcagggcctgggaaaagattcaggacccaggaacctcctgctctgcttttagttcaatcagacaaggctctaaagatccatatccagactttgtggcaaggttgcaagatgcagctcaaaaatccattgcagataataacgcccgaaaagttactgtggaaataatagcttatcaaaatgcaaatccagagtgtcaatcagccataaagccattaagaggaaaggtttcagcaggagttgatgtaattacagaatatgtgaaggcttgtgatgggattggaggagctatgcgtaaggcaatgttattggctcaagcaattacaggggttgctttaggaggacaagttaaaacatttggggaaaaatgttataattgtggtcaaatcggacatctaaaaaagaattgcccaggcttaaatacacagagcaaaaaaaaaaaagagccacctggcctgtgtccaagatgtggaaaaggaaaacattgggctaaggcatgtcgttctaaatttgataaaaatggacagccattgttgggaaatgggaagaggggccagccccaggccccgcaacaaagtggggcattcccgattcagtcatttgttcctcagggttttcagggacaacaacccccacagtaaataccaccatttcaggaaatcagccaattacaacaatacaacaattatcccctgccacagcaggcagcgctgcagtagatttatgttctactcaaatgatttctttactccctggagagcccccgcaaaagactcctacaggggtatatggcccgctgccagaagggatgttaggccttattttaggaagatctagtctaaatttgaaaggagttcaaattcatactggggtaattgactcagattataaaggggaaattcagttagtgatcagctctactgttccctggagtgccaatccaggtgatagaattgctcaattactgctcttgccttatattaaaattggggatagcaaaacagaaagaacaggagggtttggaagtaccaaccctgctggaaaagctgtttattgggctagtcagctctcagagaatagacctgtgtgtacagttactattcagggaaaacagtttgaaggattagtggatactggggctgatgtttctctcattgccttaaatcaatggccaaaaaatcggcctaaacaaaagcctgttacaggaattgttgttgtgagcactgcctcagaagtgtatcaaagtgccaggatttcacatcgtctaggacctgataatcaagagagtacagttcagcctatgattacttctattccaattaatttacggggccaagacttattagaacagtggcatgcagagattactattccagtctctctatacagctccacgagtcaagaaatcacgactaaaatgggatatctccctggcaatggactagggaaaaatggagaaggcattaaagttccaattgaggctaagggaaatccagaaagaaaaggactagggtatcctttttaagggtggccactgtagagcctccaaaacccattccatcaacttggaaaagagaaaagcctatatgggtaaatcagtggccactaccaaaacaaaagctggaggccttacacttattggcaaaagaacaattagaaaagggacatattgggccttcattttcgccttggaattctcctgtgtttgtaattcagaaaaaatcaggcagatgacgcatgctaactgatttgagagctgctaatgcagtaattcaacccatggggcctctccaacttgggctgacctctccagccatgatccccaaatattggcctttaattataattgatctgaaggattgcttttttaccattcctctggcaaaacaggattttgaaaaatttgcttttactataccagccataaatattaaagaaccagccaccagctttcattggaaagtgttgcctcagggaatgcttaatagtccaactatttgtcagacttttgtagctcaagttcttcaactagttaaagacaagtttttagactgttatatcattcattatgttgatgatattttgtgtgctgcagaaataagagacaaattaattgactgttacacatttctgcagacagaggttgcaaacgcaggcctgacaatagcatctgataagattcagacctccactccttttcattatttgggaatgcaggtagaggagagaaaaattaaaccacaaaaagtagaagtaagaaaagacacattaagaacattaaatgactttcaaaaattgctaggagatattaattggatttggccaactctaggcatccgtacttatgccatgtcaactttgttctctatcttgagagggtatccagacttaaatagtaaaagaacattaactccaggggcaactaaagaaattgaattagttgaagaaaaaattcagtcagcacaagtaaatagatcacttagccccactccaacttttaatttttgctactgcacattctccaacaggcattattgttcacaatacatatctagtggagtggtcattccttcctcacagtacagttaagacttttacattgtacttagatcaaatgggtacattaattggtcaggcaagactacgaatagtaaaattgtgtggaaaagacccagataaaatcattgttcctttaaataaggaacaggttagacaagcctttatcaattctggtgcatggaagattagtattgctgattttgtgggaattattgataatcattacccaaaagcaaaaatcttccagtttttgaaattgactacttggattttacctaaaattaccagacaaaaacctccagaaaatgctctgacggtgtttactgatggttccagcaatggaaaagcggcttacactgggccaaaagaacgagtcactgaaactcaatatcactcagctcaaagagcagaattggttgctgtcatttcagtgttacaagaatttaatcagcctattaacattgtttcagattctgcatatgtagtacaggctacaaaggatgttgagacagccctaatcaaatatagtgtggatgatcagttaaatcagctgtttaaattgttacaacaaactgtaagaaaaagaagtttcccattttatatggctcatatccgagcacatactaatttaccagggcctttaactaaggcaaatgaacaagctgacttgctagtatcatctgccttcatggaagcacaagaacttcatgccctgactcatgtaaatgcaacaggattaaaaaacaaatttgatatcacatggaaacaagcaaaaaatattgtacaacattgtgctcagtgtcaagtcttacacctgcccactcaagaggcaggagttaatcctagaggtttatgtcctgatgcattatggcaaatggacgtcacacatgtaccttcatttggaaaactgtcatttgtccatgtgacagttgatacttattcacatttcatatgggcaacctgccagacaggagaaagtacttcccatgttaaaagacatttattatcttgttttgcagtcatggcagttccagaaaaaattaaaacagataataggccaggatactgtagtaaagcatttcaaaaattcttaaatcagtggaaaattacacatacaacaggaatcctttataattcccaaggacaggccataattgaaagaactaatagaacactcaaagctcaattggttaaacaaaaaaaggaaaaagacagtaaggagtataacactccccagatgcaacttaatctagcattctatattttaaatgttttaaatatatatagaaatcagaccactacttctgcagaataacattttactggtaaaaagaacagcccacatgagggaaaactgatttggtggaaagacaacaaaaacaaaacttgggaaataggtaaggtgatgacatgggggagaggttttgtttgtgtttcaccaggagaaaatcagcttcctgtttgggtacccactagacatttgaagttctacaatgaacccatcagagatgcaagggaaggcacctccgcagagacagagaacccgcaatcgaacatcatcgactcgcagggtgaacaaaatggtgatatcagaagaacagatgaagttgccatccaccaagaaagcggggccgccgacctgggcccagctaaagaagctgacacagttagctgaaaaaagcctggaaaacacaagggtaacacaaactccagagaatatgctgcttgcagctttaatgattgtatcaacggtggttaagtctccctatgtctgcaggagccgctacagctaactatacttactgggcctatgtgcctttcccacccttaattcgggcagtcacttggatagataatcctattgaagtatatgttaataacagtgcatgggtaccaggcctcacagatgaccgtggccctgcccaacctgaagaagaaggaatgatgataaacatttccattgggtatcattatcctcctatttgcctgggaaaagcaccaggatgcttaatgcctacaatccaaaattggttgttagaagaacctactgtcagtgccaccagtaaatttacttaccatatgataagtggaatgtcactccgatcacaaatgaataattcacagaattcttcctatcaaagatcattaaaatttaggcctaaatggaaaccatgccagaaggaaattccagaagaatcaaaagacccagaagtcttagtttgggaataatgtgtggctgatactgctgtggtactacaaaacaataaattcagaattattatagactgggcccctcgaggccaattatattatgactgtatgggccagacccactcatgttcacaggctccatctgtctggcccactaatctggcctacgatagtgatttaactaaaaggctagaccaggtttatagaaggctagaaacaccctatccatggaaatggggtgaaaaggggattccatcaccccgaccaaagttagtcagtcctgttgttggttctgaacacccagaattatggaagctcactgtggccacgtaccacattagaatttggtctggaaatcaagttatgggaacaagaaatcataagccatattatactattaacctaaattccaatctgataattcctttgcaaagttgtgtaaaagccccttatatgctagttgtaggaaacatagctattaaaccagattcccaaactataatctgtgaaaattgtagattgtttacttgcattgattcaacttttgattgacagcatggtattctgttagtaagggcaagagaaggcgtgtggatccctgtgtccatggatcgaccgtgggaggcttctccatccgtacatatcttaacagaattagtaaaaggagttctaactagatctaaaagattcatttttactctgattgcagtgattatgggtcttattgcagtcacagctactgctgtggctgctggaattgctttacactcctctgttcaaactgcagaatatgtgaataattggcaaaagaattcctcaaaattgtggaattctcagactcaaatagatcaaaaattggcaaatcaaattaatgatcttagacaaactgttatttggatgagagataggctcatgagcttggaatatctttttcagttacagtgtgactggaatacgttagatttttgtattagacctcgagcctataatgaatctgaacatcactgggacatgggtagacgccatctacaaggaagagaagataatcttaccttagatatttctaaactgaaagaacaaatttttgaaacatcaaaagcccagttaaatctggtgccagaaactgaggcaatggtaaaagctgttgatagcctcacaaatcttaaccctatcacttgggttaaaaccattggaaattccactattgcaaattttgtactaattcttgtatgtctgtcctctctattgttagtctacagaggtatatccagcagctccggagagacagcgactagcgagaattgtccatgatgacgatggaggttttgtcaaaaagaaaagggggaaatgcagggaaaagaaagagagatcagactgtcacagtgtctatgtag

SEQ ID NO: 87 - DNA, 649 bp, Homo sapiens
ttagagttggcagttaggcagacatgagtgggacaggagagtgcccctcctcccaagaatgtcaggtgaccatcaggtgatggtcaggtggttattaaactgtctttctaaaataataattagtcacagctggcaccagagaccgtctcccaacagataggaaacacctgaagctggtgatcagcagcttcctgataagatctcagaagttgggggagcaggctcaagcatgcacactcaaaggcaaaatggcacagtttaaccggtatatgactttcctctgtgaatgctcaactggtaagggaaaaacacctcaagtgagcacaaacacaacttcagtaaacacagtgcgcatgtggctcctcccaggtgctggcaggccactgtgcatgtggacagcccatcccaaaggaaaaatcaggggaaaataaacacaaacccttgaatctctccagttgcctgcttggccctctgccaagtgtagtttgcttcctctcattcctgctctaaaactgtttaataaactctcgctcctgctctaaaatttgcctcagtctctccctctgccttacacctactaatgcccttggctgaattccttcctccaaggaggcaaggatcaagttgctgtagacccatacagattcgc

SEQ ID NO: 88 - DNA, 5810 bp, Homo sapiens
gtcaggcctctgagcccaagcctgcagtatacatccagatggcccgaagcaagtgaagaatcacaaaagaagtgaaaatggccagccctgccttaactgatgacattaccttgtgaaattccttctcctggctcagaagcttccacactgagcaccttgtgatcccctagcccctgcccgccagagaacaaccccctttgactgtaattttccactacctacccaaatcctataaaacgacccacccctatctccctttgctgactctgttttcggactcagcccgcctgcacccaggtgaaataaacagccttgttgctcacacaaagcccgtttggtggtctcttcacagggacgcgcgtgacatttggtgccgaaacccgggacaggaggactccttcgggagaccagtcccctgtccttgccctcactccgtgaggagatctacctacaacctcgggtcctcagaccaaccagcccaaggaacatctcaccaatttcaaatcaggtaagcggtcttttcactctcttctccagcctctcttgctacccttcagtctccctgttcttccaattccagttctttttcctctctagtagagacgaaggagacacattttatctgtggactcaaaactccagcaccagtcacagactcaggaatagtcttctcttggtgtttaatcactgcggggatgcctgcctgattattcacccacactccattggtgtctgatcaccgcgaggatgcctgccttggtcattcacccacattcccttggtggcaagtcaactgcggggatgcctgctttggctgctcacccacattgcagcccagggctgctcaccaccctccttatctgtgtctctaccctctcttttctctgggcttgcctgcttcactatgggcaaccttccaccctccattcccccttcttcttccttaggctgtattctcaaaaacttaaaacctcttcaactcttgcctgacctaaaacctaagtgtcttcgccaacaccacttggccccaatacaaactcgataatggttctaaacagccagaaaatggcacttttgatttctccattttacaagacctggatgatttttgtcgaaaaatgggcaaatggtctgaggtgcctgacgtccaggcattcttttacacatcggtccctccctagtctctgctcccaatgcaactcatcccaaatctttcttctttctctcctgtctattccttcagtctccactccaagctctgagtcctttgaatccttttctacagacccatctgacccctcccttcctccccaggctaatcctcgccaggctgagccaggtctcaattcttcctcagcctccactcccccaccctataatcctttaatcacctcccatcctcacacagggtccagcttacagtttcacgtggggagactagccctcccgcacctgctcaacaatttcctcttaaggaggtggctggagccgaaggcttagccaaggttaatgctcctttttctttatctgacctctcccaaatcagtgtttaggctctttttcatcaaatataaaaactcaacccagttcatggcccgtttggcaacaacccttagatgctttaccgccctagacccagaggggccagaaggccatcttattctcaataggcattttattacccaatctgctcctgacattagaaaaagctccaaaaattagattccggccctcaaaccccacaacaggacttaattaacctcaccttcaaggtgtacaataatagagtagaggcagccaagtagcaatgaatttctgaattgcaattcctgcctccactgtgagacaaaccccagccacatctccaggacacaagaacttccaaacgtctgaaccgcagtggccaggcgttcctccagaactgcctccccaaggatcttacttctagcgccggaaatctggccactgggccaagaaatgcccacagcccagaattcctcctaagccatgtcccatctgtgcaggaccccactggaaatcggactgtccaactcgcccagcagccactcccagagtccctggaactctggcccaaggctctctgactgactccttcccagatcttcttggctttagcggctgaagactaatgctacctgattgcctcggaagcctcctggaccatcacagacgctttgggtaactcttacagtggagggtaagtccatccccttcttaatcaatacggagcttacccactccacattaccttcttttcccttgcctccacaattgtgggtattgacggccaggcttctaaaccttttaaaactccccaactctggtgccaacttggacaacattcttctgtgcactcctttttagttatcctcacctgcccagctcccttattaggtggagacattttaactaaattatctgcttccctgactattcctagactatagccacacctcattgctgcccttttcctcagttcaaagcctccttcacatcttccccttgtatctccccaccttaatccacaagtatgggacacctctactctcccctggcaactgatcacacaccccttactatcccattaaaacctaatcacccttaacccactcaacgccaatatcccatcccacagtacactttaaaaggattaaagcctgttatcactcacctgttacagcatggccttttaaagcctataaactctccttacaattcccccattttccctgtccaaaaaccggacaagtcttacaagttagttcaggatctgcatcttatcaaccaaattgttttgcctatccaccctgtagtgctaaacccatatactctcctatcctcaatacctccctccacaacccctccacaacccattattctgttctgggtctcaaacatgctttctttactattcctttgcacgcttcatcccagccactctttgctttcacttggactgaccctgacacccatcaggctcagcaaattacctgggctgtactgctgcaaggcttcatggacagcccccattacttcagtcaaacccaaatttcttcctcatctgttacctatcttggcataattcttcatcaaaacacacatgccctccctgctaatcatgtctggctaatctcccaaaccccaaccccttctacaaaacaactcctttccttcctgggcatggttaaatactttcacctttaaatacctggttttgccatcctaacaaaaccattacataaacacaaaagaaaacctagctgaccacatagatcctaaatcctttccccattcctctttccgttccttaaaaacagccctggaagctgctcccacactagctctccctaactcatcccaaccctttttcattacacagagccaaagtgcagggctgtgcagttgaaattcttacacaagagccgggaccgtgccctgtatcctttttgtccaaacaacttgatcttactgttttaggctggccatcatgtctctgtgtggcagctgccgtcaccctaacacttttagaggccctcaaaatcacaaactatgctcaactcactctctacagccctcataacttccaaaatctattttcttcctcacacctgatgcatatactttctgctccctggctccttcagctgtactcactctttgttgagtctcccacaattaccagtgttcctggcccagacttcaatccggcctcccacattattccagataccacacctgacccccatgactgtatctctctgatccacctgacattcactccatttccccatatttccttctttcctgttcctcaccctgatcacacttggtttatccatggcagttccaccaggcctaatcaccgcttaccagcaaaggcaggctatgctatagtatcttccacatctatcattgaggctactgctctgccccctccactacctctcagcaagccaaactcattgctttaactcaagccctcactcttgcaaaggaactacgcatcaatatttatactgactctaaacatgccttccatatcctgccccaccatgctgttatatgggctgaaagaggtttcctcactacacaagggtcctccatcattaatgcctctttaataaaaatacttctcaaggtcgctttacttccaaaggaagctggagtcattcactgcaagggccatcaaaaggcatcagaccccactgctcggggcaacgcttatgctgataaggtagctaaagaagcagctagcattccaacttctatccctcatggcagtttttctccttctcatcggtcactcccacctactccaccactgaaacttccacctatcaatctcttcccacacaaggcaaatagttcttggactaaggaacatatctccttccagcctcacaggcccattctattctgtcgtcatttcataacctcttccacgtagattacaagctgctagtctgcctcttagaacctctcatttcctttccatcatggaaatctatcctcaaggaaatcacttctcagtgttccatctgctattctactactcctcagggattgttcaggccccctcccttccctacacatcaagctcggggatttgcccctgcccaggactggcaaattgactttactcacatgccctgagtcaggaaactaaaatacgtctcggtctagatagacactttcactggatgggtagaggcctttcccacaaggtcaaaaaaaggccaccgtggtcatttcttcccttctgtcagacataattcctcggtttggccttcccacctctatacggtccaataacggactggcctttattagtcaaatcacccaagcagtttctcaggctcttggtattcagtggaaccttcataccgcttaccatcctcaatcttcaggaaaggtagaatggaacagactaatggtcttttaaaaacacacctcaccaaactcagcctccaacttaaaaaggagggctctgtcaaggatagagcccaaaaactcaccaaccaagcaagtaattacgctgaacccccttgggcactccctaattggaagtcctgggtcctcccaattcttagtcctttaatacctgtttttctccttctcttatttggaccttgtgtcttccgtttagctctcaattcataaaaaaacacatccaggccatcaccaatcattctatatgacaaatgctccttctaagaaccccacaataccacccattaccccaaaatcttccttcagctgaatctctcccactccaggttcccacgccacccctaatcccactcgaagcagccctgagaaacatcgcccattatctcttcataccacccccccaaaaattttcactgccccaacacttcaatactattttatgttatttttcttattaatataagaagacaggaatgtcaggcctctaagcccaagcctgcacatatacatccagatggcctgaagcaagtgaagaatcacaaaagaagtgaaaatggccggtccctgccttaactgatatttccttgtgaaattccttttctcagaagctccccaactgagcaccttgtgaccccctccgcctgcccctgcccaccggagaacaaccccctttgactgtaattttccactacctacccaaatcctctacaacggccccacccctatctcccttcgatgattctcttttcggactcagcccgcctgcacccaggtgaaataaatagccttgttgctcacacaaagcctgtttggtggtcttttcacatggacgtgtgtga

SEQ ID NO: 89 - DNA, 2100 bp, Homo sapiens
tgcagtcagaattcttacacaagagccgggaccgcgccctgtagcctttttatgcaaacaacttgaccttactgttttagcctagccctcatgtctgcgtgtggtggctgctgctccttaatacttttagaggccctcaaaatcacaaactatgctcaattaactctctacaattctcataactttcaaaatctattttcttcctcccacctgacacatatactttttgcttcccagctccttcagctatactcactctttgttgagtctcccacaattaccattgttcctggcccggactttaatcgagcctcacacattattccggataccacacctgacccccatgactgtatctctctaatccacctgacattcaccccatttccccatatttccttctttcctgtttctcaccctgatcacatttggattattgatggcagttccaccaggcctaatcgccactcaccagcaaaggcaagctatgctatagtatcttccacatctatcattgaggctaccgctctgccccgctccactacctcttagcaagctgaactcattgcctcaactcaagccctcactcttgcaaaggaattacgcgtcaatatttatactgactctaaatatgccttctatgtcctgcaccaccatgctgttgtataggcagaaagaggtttcctcactacacaagggtcctccatcattaatgcctctttaataaaaacacttctcaaggccaatttacttccaaaggaagctggagtcattcactgcaagggccatcaaaaggcatcagatcccattgctcaggacaatgcttacgctgataaggtagctaaaagcagctagcgttccaacttctatccctcatggcagtttttctccttctcatctggccactcccacctactcccccactgaaacttccacctatcaatctcttctcacacaaggcaaatggttcttggaccaaggaaaatatctccttccagcctcacaggcccattctattctgtcatcatttcataacttcttctatgtaagttacaagccactagcccacctcttagaacctctcatttccttcccatggtggaaatctatccttaaggaaatcacttctcagtgttccatctgctattctactactcctcagggattgttcaggcccccccacccacttccctacacatgaagctcgggcatttggccccgcccaggaccggcaaattgactttactcacatgcctcgagttaggaaactaaaatacctcttggtctgggtagacactttcactggatgggtagaggcctttcccacagggtctgagaaggccaccgccgtcatttcttcccttctgtcagacagaattcctcagtttggccttcccacctctatacagtctgataatggaccaacctttattagtcaaatcacccaagcagtttttcaggctcttggtattcagtgaactaatggtcttttaaaaacacacctcaccaagctcagccaccaacttaaagaggactggacaatacttttaccacttgcccttctcagaattcgggcctgtccttggaatgctacagggtacagcccatttgagctcctgcatggacactcctttttattaggccccagtctcatcccagacaccagaccaacttggactgcgccccaaaaaacttgtcatccctactatcttctgtctagtcatacacctattcaccattctcaactacacataaatgccctgctcttgtttacactgccggtttacactgtttctccaagccatcacagctgatatctcccagtgctatccccaaaccagcactcttaactcttaaagtaaataaataatctttgctggcagggctatgctgaagctccttgggcactctaattggatgtcctgggtcctcccaattcttagtactttaatacctgtttctctccttctcttattccttttaggttttcaattcatacaaaaccgtatccaggccatcaccaataattctgtatgacaaatgtttcttccaacaaccccacaatatcgccccttaccacaaaaccttccttcagcttaa

SEQ ID NO: 90 - DNA, 756 bp, Homo sapiens
gagagacaggactagctggatttcctaggccaactaagaatccctaagcctatctgggaaggtgaccgcatccacctttaaacacgggacttgcaactttgctcacacctgaccaatcaggtagtaaagagagctcactaaaatgctaattaggcaaaaacaggaggtaaagaaatagccaatcatctatcgcctgagagcacaggaggagggacaatgattgggacataaacccaggcattcgagcagggagtggctacccactttgggtcccctcctgttgtatgggagctctgttttcactctattaaatcttgcaactgcacactcttctggtccgtgtttgttacggcttgagctgagcttttgctctccatccaccatgctgtttgccaccgtcagagacccgctgctgacttctgtccctctggatccggcagggtgtccactgtgctcctgatccagcaaggtgtccattgccactcgggatcgggctaaaggcttgccattgttcctgcacggctaagtgcctgggttcatcctaattgagctgaacactagtctctgggttccacggttctcttccctgacccacagcttctaatagagttataacactcactgcatggcccaagattccattccttggaatctgtgaggccaagaaccccaggtcagagagcaagaggcttgccaccatcttggaagcagcccgccaccatcttgggagctctaagagcaaggacccctgtaaca

SEQ ID NO: 91 - DNA, 1600 bp, Homo sapiens
gtcaggcctctgagcccaagctaagccatcatatcccttgccacatgcacatatacatccagatggcctgaagcaaatgaagaatcacaaaagaagtgaaaatggccggttcatgccttaactgataacattccaccattgtgatttgttcctgccccaccttaattgagtgattaaccttgtgaaattccttctcctggctcagaagctcccccactgagcaccttgtgacccctacccctgcctgcaagagaaaaatcccatttgactataattttccactatccacccaaatcctataaaacggccctacccctatctcgctttgctgacactcttttcagactctcttttcagactcagcttgcctgcacccaggggaaataaacagctttattgctcacacaaagcctgtttggtgggctcttcacctggacgcacgtgacatttggtgccgtgactcagatcaggagacctcccttgggagatcaattccctgtcctcttgctctttggtccatgagaaagatccacctacgacctccagtcctcagaccaaccagcccaaggaacatctcaccaattttaaatcaagtaagcggcctctttttactctcttatccaacctctgtcactatccctcaacctctttctactttcaatcatggcgccatccttcaatctctcacttctcttaatttcaattcctttccttttctggtagagacagaggagatgcgttttatccgtgaaaccaaaattccggttccaatcacagactcaggaagacagtcttcccttggcgtttaatcactgcggggacacctgcttgattattcacccacgtttcagaggtgtctgatcaccgtgggtatgcctgccttgatccttcacccttagtggcaagcaccactttcccggggggcaagcacccccccccccacaccccttctctctgtgtctctaccctctcttttctctgggcttgcctccttcactatgggcaaccttccaccctccattcctccttcttctcccttagtctgtgctctcaaaaacttaaaacctcttcaactcaaacctgacctaaaacctaaatgccttattttcttctgcaatgccacttgaccccagtacaaacttgacaatggttccaaatagccagaaaatggcactttctatttttccatactacaagatctagattatttttgtcataaaatgggcaaacggtctgagatgcctgacgtccagacattcctttacatattgatccctccctagtctctgttcccaatgcaactcatcccaaatcttccttctttccctcccgcctgtcccctaagtcccaatcccaagcattgctgagtctttccaatcttcattttctaccagcccatctgacctctcccctcctccccagactgccccaggtcactcccctccaggctgaatcaggctccaaatcttcctcagccttctctcccccacccttctatcacctcctctccccacaccccattcggcttacagtttcattccgagactagccttctcccacctgcccaacggttcctcttaaggaagtgactggagctaaa

SEQ ID NO: 92 - DNA, 5794 bp, Homo sapiens
gtcaggcctctgagcccaagctaagccatcatatcccctgacctgcacgtacacatccagatggtgggttcctgccttaactgatgacattccaccacaaaagaagtgaaaatggcctgttcctgccttaactgatgacattccaccacaaaagaagtgaaaatggcctgttcctgccttaactgatgacattgtcttgtgaaattccttctcctggctcatcctggctcaaaggctcccccactgagtaccttgtcacccccattcctgcccaccagagaacaacccccctttttcctttacctacccaaatcctacaaaacggccccacacctatctctcttcactgactctcttttgggactcagcccgcctgcacccaggtgattaaaagctttgttgctcacacaaagcctgtttggtggtctcttcacacagatgcgtgtgaaatttggtaccgtgactcggatctggggacctcccttgggagatcaatcccctgtcctcctgctctttgctccatgagaaagatccacctacgacctcaggtcctcagactaaccagcccaagaaacatctcaccaatttgaaatccagtaagtggcctctttttactctcttctccaacctccctcactatccctcaacctctttctcctttcaatctcggtgccacacttcaatctctccctgctcttaatttcagttcctttcattttctggtagagacaaaggagacacattttatccgtggacccaaaactccggcgccagtcatggactaggaaggcagccttcccttggtgtttaatcatcacagagatgcctctctgattattcacccatgtttcagaggtgtcagaccacgcagggatgcctgccttggttcttcacccttagcggcaagtcctgcttttctgtgggaggggcaagtactccaaccccttctctccatgtctctaccccttctccacctttctggggggcaagaaacccccaaccccttctacttcacccttagcagcaagtcccacttttctaggggaggggcaagtaccccaaccccttatatctctgtgtcccgatcccttatttccgtgccccaacctcttatatctctgtgccctgatcccttatttccatgccctgacctcatatctctgtgccctgatccctttcccacttttctggagggtaagaacccccgaaccccttctctccatgtctctactctcttttctctgggcttgctgccttcactatgggcaaacttccaccctccattcctccttcttctcccgtagccggtgtttttaagaacttaaaacctcttcaactctcacctgacctaaaatgtaagcatcttattttcttctgcaatgctgcttgaccccaatacaaacttgacagtagttccaaatagccagaaaatggcactttcaatttttccatcctgcaagatctaaataattcttgtcgtaaaatgggcaaacggtctgaggtgcctgatgtccaggcattctgttacacatcggtccctccctagtctctgtgcccagtgcaacttgtcccaaatcttccttctttccctctcacttgtcctctcagtcccaaccccaagggttgctgagtttttctaatcttccttttctacagacccatctgacctctcccatcctccccaggctgctcctcaccaggccaagctaggtcccaattcttcctcagcctctgctcctccaccctataatctttttatcacctccccccctcacacccagtctggcttacagtttcattccctgagtagccctcccccacctgctcagaaatttcctcttaaaaaggtggctgaagctaaaggcatagtcaaggttaatgctcctttttctctatcagacctctcccaaatcagtgagcatttaggctctttcatcaaatatgaaaaacccagcccagttcatggctcattcagcagcaatgctgagacactttacagacctagaccctaaaaggtcaaaaggctgtcttattctcaatatacattttattacccaatctgctcctgacattaaataaaactccaaaaattaaattccggccttcaaaccccacaacaggatttaattaacctcaccttcaaggtgtacaataatagaaaaaagttgcaattccttgcctccactgtgagacaacccccagccacatctccagcacacaagaagttccaaatgcctaaaccgcagtggccagacattcctccagaaccaccttccccaggggcttgatcaggcctcctccctttcctacacatcgagctcagggatttgcccctgcccaggactggcaaattgactttactcacacgcctcaagtcagaaaactaaaatatctcttagtctgggtagacactttcactggatgggtagaggactttcccacagggtctgagaaggccaccgtggtcatttcttcccttctgtcagacataattcctcagtttggccttcccacctctatacagtctgataacggaccagcctttactagtcaaatcacccaagcagtttctcaggctcttggtattcagtggaaccttcatatccattaccatcctcaatcttcaggaaaggtagaatgcactaatggtcttttaaagacacacctcaccaagctcagcctccaacttaaaaaggcttggacaatacttttacctcttgcccttctcagaattagagcctgtcctcgagatgctacagggtacagtccttttgaacttttatatggatgcactttcttgcttggccccaacttcatcccagacaccagctctctaggtgactatcttccagtcatccaacaggctagataggaaattcatcaggctgctaatcttctcttgcctattccagatccccagccatatgaagacaccctagctggacaatcagttctttataagaatctgacccctcaaactctacaacctcgatggaccggaccctacttagtcatctctagtaccccgattgccatcggcctgcaggatcctccccactgggttcaccattccagaataaagctgtgtccattggactgccagcctaatccctcctcttcctcctggaagtcgcaagtactctcccctacttcccttaaactcactcatatttctgaagaacagtgataacccttatgagcctaatacatcccttcattctattagatctgttcatccttaccctacattttcaacagggctttacgatgtcactcccaccacttgggccgagcaccaaaaaacttgtcatccctactattttctgtctagtcatactcctattctccattctcaactacttataaatgccctactcttgtttacactgccggtttacactgtttcttcaagccatcacagctgatatctcttggtgctatccccaaactgccactcttaattccctcttagagtgtgtagatgatctttgctgtcagggcactctccaatacttccaccctgatgaagttctattctttacttttatactcactcttattctcattcctattcttatgccaccctttacctctgcccagctatcttcaccacactatcaaccttgcccattctctcctagccacttctaatccctccttagtgaacaactgctggctttgtgtttccctttcttcctgtgcctacacagctgtccccgccttacagacagactgggcaacatctcctgtctccttacacctctgaacttcctttaacagctctcacctttaccctcctgaagaactcatttactttctagacaggtccagcaagacttccccagacatttcacatcagcaagctgccgccctcctctgcacttatttaaaaaacctttctccttatattaactctactccccccatatttggacctctcacaacacaaactactattcctgtggccgctcctttatgtatctctcagcaaagacccactggaattcccctaggtaatctttcaccttctcgatgttcctttactcttcatgtctgaagcccaactacacacatcactgaaacaattggagccttccagctccatattacagacaagacttctatcaatactgacaaactcaaaaacgttagcagtaattattgtttaggaagacacttaccctgcatttcactccatccttggctaccttctgcttgctcatcagactctcctcccaggccctcttcttgtttacttatacccagccccgaaaataacagtgaaagtttgctcatagatacttaacgttttctcatacaccatgaaaattgaacctcctcctctatgcagttactccatcagtccccattacaacctctgacagctgccgccctagctggatccctaggagtctgggtacaagacaccgctttcagcactccttctcacctttttactttacatctccagttttgcctcacacaaggtctcttcttcctctgtggatcccctacctacatgcgtctacctgctaattggacaggcacatgcacactagttttccttacccccaaaattcaatttgcgaatgggacggaagagctccttgttcctcgcatgacaccgacatgacaaaaaagagttattccactaattcccttgatggtccatttaggactttctgcctccactattgctctcggtactggaatagcaggcatttcaacctctgtcacgaccttctgtagcctgtctaatgacttctctgctagcatcacagacatatcacaaactttatcagtcctccaggcccaagttgactctttagctgcagttgtcctccaaaaccgccgaggccttgacttactcactgctgaaaaaggaggactgtgtatattcttaaatgaagagtgttgtttttacctagatcaatctggcctggtgtatgacaacataaaaaaactcaaggatagagccccaaaacttgccaaccaaacaagtaattatgctgaatccccttgggcactctccaattggatgtcctgggtcctcccaattcttagtcctttaataaccatttttctccttcttttatttggaccttgtatcttccgtttagtttctcagttcatccaaaaccgtatccaggccatcgccaatcattctatactacaaatgtttcttccaacaaccccacaatatcaccccttaccacaagatctcccttcagcttaatctttcccactctaggttcccacactgcccctaatcccgctcaaagcagcctgagaaacatcgcccattatctctccataccaccccccaaaaatttcaccgtcccaacactttaccactatttcattttatttttcttattaatataagaagacaggaatgtcaggcctctgagcccaagctaagccatcatatcccctgtgacctgcacgtacacatccaggtggcctgttcctgccttaactgatgacattccaccacaaaagaagtgaaaatgacctgttcctgccttaactgatgacattgtcttgtgaaattcttctcctggctcatcctggctcaaaagctcccccactgagtaccttgtgacccccactcctgcctgccagagaacagccccccattttcctttgcctacccaaatcctataaaacagccccaccctatctcccttcactgactcttttcggactcagcccgcctgcacccaggtgattaaaagctttattgctcacacacagcctgtttggtggtcttttcacacggatacgcatgaaa

SEQ ID NO: 93 - DNA, 216 bp, Homo sapiens
ttatagtgggtagctagtcaggtacgagcaggacaggagagggctccccgtacacacacaccaggacagttgggcaaccatcaggtgatggtcaggtggttgttaactggttctctaaagtaataattggtcacagctggcgccagggaacaaccgtctcctactagatagaaaacacctgaaactgatcaacagcttcccagtaagatctcagga

SEQ ID NO: 94 - DNA, 8812 bp, Homo sapiens
atggtatgaggtcaccacttctcctgttgtccttctcagttcctccccaacctccccttttccccagtttataagacaggagaaaagggagaaagcaaaaagttgaaaagaaacagaagtaagataaatagctagatgaccttggcaccaccacctggccctggtggctaaaatataatattattaacccctgaccaaaactgttggtgttatctgtaaattccagatattgtatgagaaagtactgtaaaactttttattctgttagctgatgtaggtagcccccagtcatgtttctcacgcttacttgacctattatgactttttcatgtagaccccttagagttgtaagcccttaaaagggctaggaatttcttttttggggagctcggctcttaagatacgagtctgccaatgctcccggccaaataaaaaacctcttccttctttaatctggtgtctgaggagttttgtctgtgactcgtcctgctacatttcttggttccctggccaggaagcaaggtaattgaaggacagtcgaggcagccccttaggtggcttaggcctgccctgtggagcatccctgcaggggactctggccagcttgagtgacgcggatcctgagagcgctcccaggtaggcaattaccccggtggaaagcctcgtcagagcagtgcgtggcaggcccctgtggaggatcaatgcagtggctgaacactgggaaggaacaggcacttggagtccagacatttgaaacttggtaagactggtcttcggaacttgcccactccatttgagtggaagcgtggcctgatcaaccacggcatgcctgtactggcactttggtttttgtttttgacttgacttgaattgcttgatactttggttttggtttgacctggcttggatttctggatactctgattttggttttgattctggtttggtgaaaactgaaaaagtgtgtgtgtgcactttttacccattctttgttttgtggtgtgcatgtggtgtgagcttggtgttttgtcttgaggaaacatggatcagacacaaaataagcctactcctctaggaactatgttgaaaaattttaagaagggatttaatggagactatggggttactatgacaccagggaaacttagaactttgtgtgaaatagattggccaacattagaagtgggttggccatcagaaggaagcctggacaggtcccttgtttctaaggtatggcacaaggtaactagtaagtcaggacactcagaccagtttccatacatagacacttggttacagctggtgctagaccccccacagtggctaagagggcaggcagcagcagtgctagtagcaaagggacagatagtcaaggaaggattctgctccacccgctgagggaaatcaactcctgaagttctgttcgaccaaacatcagaagatccattgcaggagatggcaccagtgatcccagtgttgccctccccttatcagggagagaggctccccacttttgagtccacagtgcttgcgcctctgccagacaaatgtatccctaggccactcagagtagacaagagaggaggtgaagcctcgggagaaacccctcccttggcagctcatttaagacccaaaacagggatacaaatgcccctgagagagcagcagtatactggaatagatgaggatgggcacatggtggagagtcgtgtttttgtgtaccagcccttcacctctgccgaccttctcaactggaaaaacaataccccgtcctatactgaaaagccgcaagctctaattgatttgctccaaactattatccagacccataaccccacttgggctgattgccaccagttgctcatgttcctctttaaaacagatgaaaggtgaagggtgcttcaagcagcaactaagtggctagaggaacatgcactggctgattaccaaaacccccaagagtatgtaaggacacagttaccaggaaccgacccccagtgggacccaaattaaagagaggatatgcaaaggctaaaccgatacaggaaagctctcttagaaggattaaagaggagagcccagaaggccacaaacattaacaaggtctctgaggtcattcagggaaaagaagaaagtccagcaaaattctacgagagactgtgtgaggcttattgtatgtatactccctttgatcccgatagccctgaaaatcaacgcatgattaacatggctttagttagtcaaagcacagaagacattagaagaaaactgcagaaaaaggctgggtttgcagggatgaacacatcacagttattagaaatagccaaccaggtgtttgtaaacagggatgcagcaagccgtaaggaaaaccacatagagaatgaacgtcaggcccggcgaaacgccgacctgttagctgcagcaattagaggggtccccccaaagaggcaagggaaaaggggggccctgggaaagaaactcagcctggctgtcagagcttgcagtgtaatcagtgtgcttatcgtaaagaaataggatattggaagaacaaatgccctcagctaaaaggaaaacaaggtgactcggagcaggaggctccagacaaggaggaaggggccctgctcaacctggcagaagggttattggactgagggggactgggctcaaggacctccaaagagcctatggtcaggatgacagttgggggtaaagacattgattttcttgtagataccagtgctgaacattcggtagtaactgcctcagtcgcccccttatccaaaaagactattgacatcatcggagccatgggagtttcagcaaaacaagctttctgcttgccccagacttgtactataggaggacataaagtgattcatcagtttttgtacatgcctgattgtcccttgcccttgttgggaagagacttgcttagcaaactgagagccactatctcttttacagagcacggctctttgctgctaaagttacccggaacaggagtcattatgacccttatgctcccccgagaggaggaatggagacttttcttaactgagccgggccaagagataagaccagctctggctaagcggtggccaagagtgtgggcggaagacaaccctccagggttggcagtcaaccaagcccccgtgcttatagaagttaagcctggggtccagccggttaggcaaaaacagtacccggtcctcagagaagctcttgaaggtatccaggtccatctcaagtgcctaagaacctttagaattatagttccttgtcagtctccatggaacactcccctcctgcctgttcccaagcctgggaccaaggactacaggccggtacaggatttgcgcttggttaatcaggctacagtgactttacatccaacagtacctaacctgtacacattgctggggttgctgccagctgaggacagctggttcacctgcttggacctgaaagatgctttctttagcatcagattagcccctgagagacagaagctgtttgcctttcagtgggaagatccagagtcaggtgtcactactcaatacacttggacccagcttccccaaaggttcaagaactcccccaccatctttggggaggcgttggctcgagacctccagaagtttcccaccagagacctaggctgcgtgttgctccagtacgttgatgaccttttgctgggacaccccacggcagtcgggtgcgccaagggaacagatgctctactccggcacctggaggactgtgggtataaggtgtccaagaaaaaaagctcagatctgccgacagcaggtatgttacttgggatttactatccaacagggggagcacagcctgggatcagaaagaaagcaggtcatttgtaatctaccggagcctaagaccagaaggcaggtgagagaattcttaggggctgtgggtttttgcagactgtggatcccaaactttgcagtattagctaagcctttgtatgaggtcacaaaggcgggggaccaggaaccttttgaatggggatcccagcaacagcaagcctttcatgagttaaaggaaagacttatgtcagtcccagccctggggctacctgatctgacaaagccttttacattgtatgtgtcagagagtgaaaagatggcagttggagttttaacccaaactgtggggccctggctgaggccggtggcctacctctctaaacaactagacggggtttctaaaggatggcccccgtgtttgagggccttggcagcaactgccctgctagtacaagaagcagataagctgattcttgggcaaaacctgaacataaaggacccccatgctgtggtgactttaatgaatactagaggacatcattggctaacgaatgctagacttactaagtaccaaagtttgctttgtgaaaatccccatataaccattgaagtttgtaacaccctgaaccccgctaccttgctcccagtattagagatccctgtcgagcatgactgtgtagaagtgttggactcagtttactctgggcatcagtagactgggaactatacgtggatgggagcagctttgtcaacccacaagaagagagatgtgcagggtatgcggtggtaactctggacactgttgctgaagccagatcgtttccccagggcacttcaactcagaaagctgaactcattgctttaattcgggccttagaactcagtgaaggtaagactgtaaacatttacactgactcttgatatgtctttttaacccttcaagtgcatggagcattatgtaaagaaaagggcctattgaactctgggggaaaagacataaaatatcaacaagaaatcttgcaattattagaagcagtatggaaaccccacaaggtggctgttatacattgcggaggacaccagtgagcttccaccttggtgggtttggggaattcctgcactgacttagaggctcaaaaagcagcatctgcccccttccgggcatcagtgacagcccccctgctccctcaagcacctgatcttgtacctacttattctaaagaagaaaaggactttctccaggcagagggaggacaagtgatggaggaaggatggatttggttaccagatgggagagtagctgtgccacagctgctaggagctgcagttgtactggctgtgcataaaaccacccatctaggtcaggaatcacttgaaaagttgttaggctggtatttctacatctcgcatttgtcagcccttgccaaaacagtgacgcagcggtgtgttacctgccgacagcataatgcgagacaaggtccagctgttccccctggcatacaagcttatggagcagccccctttgaagatctccaggtggacttcacagagatgccaaagtgtggaggtaacaagtatttactagttcttgtgtgtacctactctgggcaggtggaggcttatccaacacgaactgagaaagctcatgaagtaactcgtgtgcttcttcgagatcttattcctagatttggactgcccttacggattggctcagataatgggctggtgtttgtggctgacttggtacagaagacggcaaaggtattggggatcacatggaaactgcatgctgcctaccagcctcagagttccggaaaggtagagcggatgaatcggactatcaaaaatagtttagggaaagtatgtcaagaaacaggattaaaatggatacaggctcttcctatggtattatttaaaattagatgtaccccttctaaaagaacaggatattccccttatgaaatattatatcataggccccctcctatattgcggggacttccaggcactccccgagagttaggtgaaattgagttacagcgatagctacaggcttcaggaaaaattacacaaacaatctcggcctgggtaaatgagagatgccctgttaacttattctccccagttcaccctttctccccaggtgatctagtgtggatcaaggactgaaacgtagcctgtttgtgtccacggtggaaaggaccccagactgtcatcctgagcactcccaccgctgtgaaggtagagggaatcccaacctggatccaccacagccgtgtaaaacctgcagtgcctgaaacctgggaggcaagaccaagcccagaaaacccctgcagagtgaccccgaagaagacaacaagccctgctccagtcacacccggaagctgactggtccacgcacggccgaagcatgcagaagctcatcatgggattcatttttcttaaattttggacttatacagtaagggcttcaactgatcttactcaaactggggactgttcccagtgtattcatcaggtcaccgaggtaggacagcaaattaaaacaatgtttctgttctatagttattataaatgtataggaacattaaaagaaacttgtttgtataatgctactcagtacaatgtatgtagcccaggaaatgaccgacctgatgtgtgttataacccatctgagcctcctgcaaccaccatttttgaaataagaataagaactggccttttcctaggtgatacaagtaaaataataactagaacagaagaaaaagaaatccccaaacaaataactttaagatttgatgcttgtgcagccattaatagtaaaaagctaggaataggatgtgattctcttaactgggaaaggagctacagaataaaaaataaatatgtttgtcatgagtcaggggtttgtgaaaattgtgcctattggccatgtgttatttgggctacttggaaaaagaacaaaaaggacccggtttatcttcagaagggggaagccaacccctcctgtgctgctggtcactgtaacccactagaactaataattaccaatcccctagatccccattggaaaaagggagaacgtgtaaccctggggattgatgggacagggttaaacccccaagttgccattttaattagaggggaggtccacaagtgctctcccaaaccagtatttcaaaccttttataaggagctgaatctgccagcaccagaatttccaaaaaagacaaaaaatttgtttctccaattagcagaaaatgtagctcattcccttaatgttacttcttgttatgtatgcgggggaaccactatcggagaccgatggccttgggaagcccgagagttggtgcctactgatccagctcctgatataattccagttcagaaaacccaagctagcaacttctgggtcctaaaaacctcaattattggacaatactgtatagctagagaagggaaagactttatcatccctgtaggaaagcttaattgtataggacagaagttgtataacagtacaacaaagacaattacttggtggggcataaaccacactgaaaagaatccatttagtaaattttcaaaattaaaaactgcttgggctcatccagaatctcatcaggactggatggctcccgctggactatactggatatgtgggcacagagcctacattcggttacctaataaataggcaggcagttgtgttattggcactattaagtcgtcctttttcttattacccataaaaacaggtgagaccctaggtttccctgtctatgcctcccgagaaaagagaggcatagttataggaaactggaaagataatgagtggcgccctgaaaggatcatacagtattatgggcctgccacatgggcacaagacggctcatggggataccgaacccccatttacatgctcaatcggatcatacggttgcaggccatcttagaaataattactaatgaaactggcagagctttgactgttttagctcggcaggaaacccaaacgaggaatgctatctatcagaatagactggccttggactacttgctagcagctgaaggaggagtttgtggaaaatttaacttaaccaattactgcctacaaatagatgatcaaggacaggtggttgaaaacatagtcagggacatgacaaaggtggcacatgtgcctgtacaggtttggcacaagtttaatcctgagtctttatttggaaaatggtttccagctataggaggatttaaaaccctcattgtaggtgtattgctagtgataggaacttgcttgctgctcccctgtgtattacccttgctttttcaaatgataaaatattttgttgttactttagttcatcagaaaacttcagcacatgtgtattatacaaatcactatcgctctatctcacaaagagactaaaaaagtgaggacgagagtaagaactcccactaaaagtgaaaattctcaaagggggggaaatatggtatgaggtcgccacttctcctgttgtccttctcagtttctccccaacctccccttttccctagtttataagacaggagaaaagggagaaagcaaaaagttgaaaagaaacagaagtaagataaatagctagacgaccttggcaccaccacctggccctggtggctaaaataataataatattattaacccctgaccaaaactattggtgttatctgtaaattccagacactgtatgagaaaatactgtaaaactttttgttctgttagctgatgtatgtagcccccagtcatgtttctcacgcttacttgatctattatgactttttcatgtagaccccttagagttgtaagcccttaaaagggctaagaatttctttttcggggagctcggctcttaagacacgagtctgccaatgatcccggccgaataaaaaacctcttccttctttaatctggcgtctgaggagttttgtctgcgactcatcctgctaca

SEQ ID NO: 95 - DNA, 351 bp, Homo sapiens
gtcaggcctctgagcccaaacctgcatgtattcatccagatggcctgaagaatcacaaaagaagtgaaaatggcctgttcctaccttaactgacaatattaccttgtgaaattccttctcctggctcatcctggctcaaaagctcccccactgagcaccttgtgacccccacccctgccagccagagaacaaccccctttgactgtaattttccactacctacccaaatcctataaaacagccccacctctatctcccttcgcttcagcccacctgcacccaggtgattaaaaagctttattgctcacacaaagcctgtgtggtggtctctgcacacagacacgcatgaaa

SEQ ID NO: 96 - DNA, 972 bp, Homo sapiens
gtggggaaaagaaagagatatcagattgttactgtgtctgtgtaggaagaagtagacataagagactccattttgttctgtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtgcccagagacacactacactgcggaagactgcagggacctctgcctaggaaagccaggtattgtccaaggtttctccccatgtgatagtctgaaatacagcctcgtgggaagggaaagacctgactgtcccccagcccgacacccgtaaagggtctgtgctgaggaggattagtaaaagaggaaggaaggcctctttgcagttgagataagaggaaggcatctgtctcctgctcatccctgggcaatggaatgtctcggtgtaaagcccgattgtatatcccatctactgagataggagaaaactgccttaggactggaggtgggacatgctggcagcaatactgctctttaaggcattgagatgtttctgtatatgcacatcaaaagcacagcacttttttctttaccttgtttatgatgcagagacatttgttcacgtgtttacctgctgatcttctctccactattatcctattgtcctgccacatccccctctccggaaatgcccgataatgatcaataaatactaagggaactcagaggccagtgctggcatgggtcctccatatgctgaacgccggtcccctgggcccatttttctttctctgtactttgtctctgtgtctctttcttttccaagtctctccttccacctaacgagaaacgcccacaggtgtggaggggcaacccatcccttca

SEQ ID NO: 97 - DNA, 301 bp, Homo sapiens
gggtcaggcacaaggtaagcccaccccagcaggaactatgttgaaaattttcaaaaaaggatttaagggagactatggagtactatgacaccaggaaaacttaaaactttgtgtaagatagactggccagcattagaggtgggttggccatcagaaggaagcctggacaggtcccttgtttcaaaggcatggcacaagacaacctggaagccagggcacccagaccagttcctgtacatagacactcggttacagctggttttagaccccccaccccacagtcgttgagagaacagcagca

SEQ ID NO: 98 - DNA, 2280 bp, Homo sapiens
tggccagttcctgccttaactgatgacattaccttgtgaaattccttttcctgactcatcctggctcaaaacctccccgactgagtaccttgtgacccccaaccctgcccgcctgagaacatccccctttaactgtaattttcctttacttacccaaaccctataaaacagctccatccctatctcccttcgctgactctcttttcggactcagcccgcctgcacccaggtgattaaaaagctttattgctcacacaaagcctgtttggtggtctcttcacacggacgcaagtgaaatttggtgcctccctgccaattgtgtctgaccccttctctctgtatctctaccccttctctacttttctggagggcaagaatcccctgaccccttctcttcgtgtctctaccccttctgcacttttctggagggcaagaaccccccaaccccttctctccgtgtctctactctcttttctctgggcttgcctccttcactatgggcaagcttctgccctccattcccccttcttctcccttagcctgtgttcttaaaaacctaaaacctcttcaattcacacctgacctaaaacctaaatgccttattttcttccgcaatgccgcttgaccccaatacaaatttgacagtggttccaaatagccagaaaatggcactttcaatttctacatcctacaatatctaaataattcttatcgtaaaataggcaaacagtctgaggtgcctgatgtccaggcattctttgacacctcggtccctccctagtctctgtccccaatgcgatttgtcccaaatcctccttctttccctctcgcctgtcccctcagtcccaaccccaagtgttgctgagtctttctaatcttccttttctacagacccatctgacctctcccctcatcaccaggtcaagctaggtcccaactcttcctcagcctccgctcctccaccctataatccttttatcacctcccctcctcacacccggtccggcttacagttttcttcctgcacctgcccagcaatgtcctcttaaaaagtggctgcagccaaaggcatagtcaaggttgatgctcctttttctttatccaacctctcccaaatcagttagcgtttagactctttcatcaaatatgaaaaacccagcccagttcacggcccctttggcagcaaccctgagacgctttacagccctagaccctgaaaggtcaaaaggccgtcttattctcaatatacattttattttattacccaatctgcacccaacattaaataaagctagaaaaattaaattccagccctcaaaccccacaacaggacttaactaacctcaccttcaaggtgtacaataacagaatagaggcagccaagtagcaacatatttctgagttgcaattccttacctccactgtgagagaaacctcaaccacatctccagcacacaaggacttcttccaaacacctaaaccacagtggccaggcgttcctccaggcctgcctcccccaagagcttgctacaagtgccagaaatctgaccaccgggccaaggaatgccggcagcccaggattcctcctaagccgtgtcccatctgtgcgggaccccactggaaattggactatcaaactcacccggcagccactcccagagcccctggaactctggcccaaggctctctggctctttcccagatcttcttcgcttagtggctgaagactgacgctgcctgatcgcctcagaatcttcttagaccatcacagatgctttaagtaactctcacagtagaaggtaagtccgtccccttcttaatcaatactgaggctacccactccacattaccttcttttcaagggcttgtttcctttgcctccataactgttgtcggtattgacggccaggcttctaaacctcttaaaactccccaactgtggtgccaacttgcacagcattcttttatgcactcctttttagttatccccacctgcccagttcccttattaggtcaagacattttaactaattatctgcttccctgactattcctaggctacagccacacctcgttgccgccttttcccccagttcaaagccgccttcacatcctgcccttgcatctccccaccttaacccagaagtataagatacctctactccctccttggcgactgatcatgtaccccttaccatcccattaaaacctaatcactcataccccactcaatgtcaatatcccatcccgcagcatgccttaaaaagattaaagcctgtt

SEQ ID NO: 99 - DNA, 5659 bp, Homo sapiens
gtcaggcctctgagcccaagctaagccatcatatcccctgtgacctgcacgtacacatccagatggccggttcctgccttaactgatgacattccaccacaaaagaagtgaaaatggcctgttcctgccttaactgatgacactgtcttgtgaaattccttctcctggctcatcctggctcaaaagctccaccactgagtaccttgtgacccccactcctgcccgccagagaacccccctttttcctttacctacccaaatcctataaaacggccccacaccatctcccttcactgactctcttttcggactcagctcgcctatacccaggtgattaaaagctttattgctcacacaaaacctgtttggtggtctgttcacatggacgttcatgaaatttggtgccatgactcggatcaggggacctcccttgggagatcaatcccctgtcctcctgttctttgctccgtgaaaaagatccacctatgacctcaggtcctcagacccaccagcccaaggaacatctcaccaattttaaattgggtaagcggcctctttgtactctcttctccaacctccctcactatccttcaacctccttcacctttcaatcttggcgccacacttcaatctctcccttcttttaatttcaattcctttggttttctggtagagacaaaggagacacgttttatccgtggacccaaaactccagcgccggtcaccaactgggaaggcagccttcccttggtgtttaatcatttcagggacgcctctgtgattattcacccacgtttcagaggtgtcagaccacgcagggacacctgccttggtccttcacccttagcggcaagtcctgcttttctgtggaaggggcaagtaccccaaccccttctctccatgtctctaccccttctccgcctttcttgggggccagaaagccccaaccccttctccttcacccttagcggcaagtcccacttttctgggggaggggcaaataccgcaacctcgtatctctgtgcccctatcccttatttccgtgccccaacctcttatatctctgcaccccgatcccttatttccgcgccccaacctcttatatctccatgccccaatcccttatttctgcaccctgacctcctttctctgtgccccggcccctttcccgcttttctggagggtaagaacccccaaaccccttccctccctgtctctactctctcttttctctgggcttgcctccttcactatgggtaaacttccaccctccattcctccttcttctcccttagcctgtgttcttaagaacttaaaacttcttcaactctcacctgacctaaaatctaagcatcttattttcttctgcaatgctgcttgaccccaataaaaactcgacagtagttccaaatagccagaaaatggcactttcaatttttccatcctgcaagatctaaataattattgtcgtaaaatgggcaaacggtctgaggtgcctgacgtcccggcatcttttacacattggtccctccctagtctctgtgcccagggcaactcgtcccaaatcttccttctttccctcccgcctgtcccctcagtcccaaccccaagcgtatctgagtctttctaatcttccttttctacagacccatatgacctctcccctcctccccaggctgctcctcgccaggccaagctaggtcctaattcttcctcagcctcagctcctccaccctatgatctttttgtcacctcccctcctcactcccggtccggttcataatttcattccgtgagtaggcctccctcacctgcccagcaatttcctcttaaaaaggtggctgaagctaaaggcatagtcaaggttaatgctcctttttctttatcagacctctcccaaatcagtgagcatttaggctctttcatcaaatatgaaaaacccagcccaattcatggctcattcggcagcaaccctgagacgctttacagccctagaccctaaaaggtcaaaaggccatcttattctcaatatacatttcattacccaatctgctcccaacattaaataaaactccaaaaattaaattccagccctccaaccccacacaggatttaattatcttgccttcagggtgtacaataatagaaaaaagttgcaattccttgcctccactgtgagacaaaccgcagccacatctccagcacacaagaacttccaaatgcctgaacctcagtgaccaggcgttcctccagaacctcctcccccaggagcttgctacaagtgccagaaatctgaccaccaggccaaggaatgcctgcagcccaggattcctcctaagccatgtcccatctgtgcaggaccccactggaaatcggactgttcaactcacctggcagccacttccagagtccctggaactctggcccaaggctctctgactgactccttcccagatcttcttggcttagcagctgaagactgacactgcctgattgcctcagaagcctacaggaccatcacagatgctctaggtaactctcacagtggaaggtaagtccatccccttcttaatacggaggctactcactccacattaccttattttcaagggcctgtttcccttgcttccataactattgtgtgtattgacggccaggcttctaaaccgcttaaaattccccaactctggtgccaatttagacaatactcttttaagcactcctttttagttatccccacctgcccatttcccttatcaggccgagacactttaactaaattatctgcttccctgaccattcctaggctacagccacacatcattgctgccttttcccccagttcaaagccttctttacatcctccccttgtatctccctatcttaacccacaagtataagacacctctactccctccttagcgacagatcatgcaccccttaccatcccattaaaacctaatcactcttaccccgctcaatgccaatatcccatctcacagcatgctttgaaaggattaaagcctgttatcactggcctgttacagcatggccttttaaatcctataaactcttcttaccattcccccattttacctgtcctaaaaccagacaaggcttataggttagttcagaatctgccccttatcaaccaaattgttttgcctatccaccccgtggtgccaaacccatatactctcctatcctcaatacctcccttcacaacccattattctgttctagatctcaaacatgctttctttactattcctttgcacccttcatcccagcctctcttcgctttcacttggactgaccctgacacccattaggctcagcaagttacctgggctgtactgccacaaatcttcgcagatagcccccattacttcagtcaagcccaaatttcatcctcatctgttacctatctcggcataattctcataaaaacacacgtgctctccctgctgatagcgtccgattaatctcccaaacctcaatcccttacaaaacaacaactcctttccttcctaggcatggttagtgcagtcagaattcttacacaagagccaggaccacaccctgtagcctttctgtccaaacaacttgaccttactgttttagcctagccctcatgtctgcgtgcagcggctgccgctgctttaatacttttagaggccctaaaaatcacacactatgctcaactcactctctacgtttctcataacttccaaaatctattttcttcctcatacctgatgcatatactttctgctccccagctccttcagctgtactcactctttgttaagtcgcacaattaccattgttcctggcccggacttcaatccggcctcccacattattctggataacacacctgaccctcatgactgtatctctctgatccacctgacattcaccccatttccccatattttcctctttcctgtacctcaccctgatcatgcttgatttattgatggcagttccaccaggcctaatagccacacaccagcaaaggcaggcttatgctatagtacaagccactagcccgcctcttagaacctctcattttctttccatcctggaaatctatcctcaagaaaataacttctcagtgttccatctgctattctactactcctcagggattattcaggccccctcccttccccacacatcaagctcgaggatttgcccccacccaggactggcaaattagctttactcaacatgccctgagtcaggaaactaaaatacctcttagtctaggtagatactttcactggataggtagaggcctttcctacagggtctgagaaggccactgcagtcatttattccgttctgtcagacataattcctcagtttagccttcccacctctatacagtctgataacagacgagcctttattagttaaatcagccaagcagtttttcaggctcttagtattcagtgaaacctttatatcccttacggtcctccgtcttcaagaaaagtagaatggactaaaggtcttttaaaaacacacctcaccaagctcagccaccaacttaaaaaggactggacaatacttttaccactttcgcttctcagaattcaggcctgtcctcggactgctacaaggtatagcccatttgagctcctttttgttaggccccagtctcattccagacaccagaccaacttggactgtgccccagaaaacttgtcatccctactatcttctgtctagcctagtcatactcctattcactgttctcaactattcatacatgccctgctcttgtttacgctgccagtttacactgtttctccaagccagcacagctgatatctcctggtgctatccccaaaccgccactcttaactcttaaagtaaataaataatctttactggcaaggctatgccgaacctccttaggcactctgtaattagatgtcctaggtcctcccaattcttagtcctttaatacctgtttttctccttctcttattccgtttagtttttcaattcatacaaaactgtatccaggccatcaccaataattctaaatgacaaatgttacttctaacaaccccacaatatcacctcttaccacaaaatcttccttcagcttaatctctcccgctctaggttcccatgccacccctaatcccgctggaagcagccctgagaaacatcgcccattctctctccataccacccccaaaaatttccaccgtcccaacactttaccactgtttcattttatttttcttattaatataagaagacaggaatgtcaggcctctgagcccaagctaagccatcatatcccctgtgccctgccttaactgatgacattccaccacaaaagaagtgaaaacggcctgttcctgccttaactgatgacattgtcttgtgaaattccttctcctggttcatcctggctcaaaagctcccccactgagtaccttgtgacccccactcctgcccaccagagaacaacccccctttttcctttacctacccaaatcctataaaacagcccaaccccatctcccttatctgactctcttttcggactcagccctcctgcactcaggtgattaaaactttattgctcacacaaagcctgtttggtggtgtcttcacacggacacgaatgaaa

SEQ ID NO: 100 - DNA, 5888 bp, Homo sapiens
gtcaggcctctgagcccaagccaagtcatcgcatcccctgtgacttgcacgtatacacccagatggcctgaagtaactgaagaatcaccaaagaagtgaatatgccctgccccaccttaactgatgacattccaccacaaaagaagtgaaaatggccagtccttgccttaagtgatgacattcccttgtgaaagtccttttcctggctcatcctggctcaaaaagctcccccactgagcaccttgcgacccccactccagcccgccagagaacaaaccccctttgactgtaattttcctttacctacccaaatcctataaaacggccccacccttatctcccttcgctgactatcttttcggactcagcctgcctgcaaccaggtgaaataaacagccatgttgctcacacaaagcctgtttggtggtctcttcacatggacgtgcatgaaatttggtgctgtgactcggatcgggggacctcccttgggagatcaatcccctgtcctcctgttctttgctccgtgagaaagatccacctacgacctcaggtcctccgaccgaccagcccaagaaacatctcaccaatttcaaatccggtaagtggcctcttcttactctcttctccaacctctctcactgtccctcaaccactttcttctttccattcttcaatctctcccttctcttaatttcaattcctttcattttcagggagagacaaaggagacacgttttatccgtggacccaaaactccggcgccggtcacggactgggaaggcagccttcccttggtgtttaatcattgcagggacgcctctctgattatacacccacgtttcaagggtgtcagaccacgcagggatgcctgccttggtccttcacccttagcggcaagtcccacttttctggggaaggggcaagtacctcaaccccttttctccttgtctctaccccttctctgcttttctgggagaggggcaagtacccctcaaccccttctctccttgtctctaccccttctctgctttcctggggcaggggcaagtacccctcaaccccttctccttcacccttagcggcaagtcctgctttcctggggcaggggcaagtacccctcaaacccttctctttcacccttagtggcaagtcccgcttttctagggggcaagaacccccaatcccttatttccgcaccccaacctcgtatctctgtgccccaataccttatttctgtgccccgacctcttatttccatgccccaaccccttatttctgtgccccatcccttatttccatgccctgacctcttatctctgcgccccaaccccttttcccacttttctggaaggtaagaacccccgaaccccttccctccgtttctctactctctcttttctctaggcttgcttccttcactataggcaactttccaccctccattcctctttctactcccttggcctgtgttctcaaaaacttaaaacctcttcaactcacacctgacctaaaacctaaatgccttattttcttctgcaatgccacttgaccccaatacaaactcaacagtagttccaaatagccagaaaacggcactttgaatttttccatcctacaagatctaaataattcttgtcgtaaaataggcaaacggtctgaggtgcctgacgtccaggcatcctttacacatcagtcccttcctagtctctgtgcccagtgcaacccgtcccaaatcttccttctttccctcctgcctgtcccctcagtaccaacaccaagcgtcgctgagtctttctaatcttccttttctacagacccatctgacctctcccctcctcgccaggccgagctaggtcccaattcttcctcagcctccgctcctccaccctataatctttttatcacctcccctcctcacacctggtccggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatgcagcccagttcatgatttgtttggcagcaaccctgagacgctttacagccctagaccctaaaaagccaaaaggccgtcttattctcaaaatacattgtattacccattctgctccgaaataaaactccaaaaattaaattccagccctcaaaccccacaacagtatttaattaacctcgcctttaaggtgtacaataatagaaaaaagttgcaattccttgcctccactgtgagacaaaccccagccacatctccagcacaagagaacttccaaacgcctgaaccgcagcagccaggcgttcctccagaacctcctcccccaggagcttgctacacatgccggaaatctggccactgggccaaggaatgcccgcagcctgggattcctcctaagccgcgtcccatctgtgtgggaccccactgaaaatcggactgttcaactcacctggcagccactcccagagcccctggaactctggcccaaggctctctgactccttcccagatcttctcggcttagcggctgaagactgacactgcccgattgcctcggaagccccctagaccatcaaggacgctgagcttcaggtaactctcacagtggaaggtaggcccgtccccttcttaatcaatacggaggctacccactccacattaccttcttttcaagggcttgtttcccttgcctccataactgttgtgggtattgacggccaggcttctaaacctcttaaaactccccaactctggtgccaacttagacaatactcttttaagcactccttttcagttatccccacctgcccagttcccttattaggctgagacactttaactaaattatctgcttccctgactatccctggactacagctatatctcattgccacccttcttcccaatccaaagcctcctttgcgtcctcctcttgtatccccccaccttaacccacaaatatgagatacctctactccctccttggcgaccgatcatgcaccccttaccatctcattaaaacctaatcaccattaccccactcagcgccaatatccaatcccgcagcacgcttgaaaaagattaaagcctgttatcactcgcctgctacagcatggccttttaaaacctataaactctccttacaatttccccattttacctgtcctaaaaccagaagagccttacaacttagttcagaatctgtgctttatcaaccaaattgttttgcctatccaccccgtggtgccaaacccatatactctcctatcctcaatacctgcctctacaacccattattctgttctagatctcaaacatgctttctttactattcctttgcacccttaatcccagcctctcttcgctttcacttggactgaccctgacacccatcaagctcagcaaattacctaggctgtactgccgcaaagcttcacagacagcccccattacttcaatcaagcccaaatttcctcctcatctgttacctatcttggcataattctcataaaaacacacgtgctctccctgccaatcgtgtctgactgatcactcaaaccccagcaccttctacaaaacaacaactcctttccttcctaggcatggttagcgcggtcagaattcttacacaagagccaggaccgcaccctgtagcttttctgtccaaataacttgacattactgttttagcctagccctcatgtctgcgtgcagcggctgccgctgcattaatacttttagaggccctcaaaatcgcaaactgtgctcaactcactctctatagttctcataacttccaaaatctattttcttcctcatacctgacgcatatactttctgcttcctggctccttcagctatactcactctttgttgagtctcccacaattaccgttgttcctggcccggacttcaatctggcctcccacattattcctgataccacacctgacccccatgactgtatctctctgatccacctgacattcaccccatttccccaaatttccttctttcctgttcctcaccctgctcacacttgatttattgatggcagttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcgaggatttgcccccgcccaggactggcaaattagctttactcaacatgccctgagtcagataactaaaatacctcttagtctaggtagatactttcactggataggtagaggcctttcctacagggtctgagaaggccaccgcagtcatttcttcccttctgtcggacataattcctcagtttaggcttcccacctctatacagtctgataacagacgagcctttattagtcaaatcagccaagcagtttttcaggctcttagtattcagtgaaacctttatatcccttacggtcctccgtcttcaagaaaagtagaatggactaaaggtcttttaaaaacacacctcaccaagccagccaccaacttaaaaaggaccggacaatacttttaccactttcccttctcagaattcaggcctgtcctcggaatgctacagggtacagcccatttgagctcctgtatagatgctctttttattaggccccagtctcattccagacaccagaccaacttagactgtgcccccaaaaaaacttggcatccctactatcttctgtctagtcatacatactcctattcaccgttctcaactactcatacatgccctgctcttgattacactgccagtttacactgtttttccaagccatcacagctgatatctcctgatgctatccccaaactgccacacttaactcttgaagtaaataaataatctttgctggcaggactatgctgaatctccttaggcactctctaatcagatatcctgagtcatcccaattcttagacgttttatacctgtttttctccttccgttattccatttagtttctcaattcatccaaaaccgtatccaggccatcaccaaatgtttcttctaacaaccccacaatatcaccccttaccacaagacctcccttcagcttaatctctcccactctaggttcccacaccgcccctaatcccgcttgaagcagccctgagaaacatcgcccattctctctccataccaccccccaaaaatttttgccgcgccaacacttcaacatcgttttgttttatttttcttattaatataagaaggcaggaatgtcaggcctctgagcccaagccaagccatcgcatcccctgtgacttgcacgtatacacccagatggcctgaagtaactgaagaatcacaaaagaagtgaatatgccctgccccaccttaactgatgacattccaccacaaaagaagtgaaaatggccagtccttgccttaagtgatgacattcccttgtgaaagtccttttcctggctcatcctggctcaaaaagcacccccactgagcaccttgtgacccccactcctgcccgccagagaacaaaccccctttgactgtaactttcctttacctacccaaatcctataaaacggccccacccttatctcccttcgctgactctcttttcggactcagcctgcctgcacccaggtgaaataaacagccatgttgctcacacaaagcctgtttggtggtctcttcacagggacgtgcatgaaa

SEQ ID NO: 101 - DNA, 302 bp, Homo sapiens
tgggtcaggcacaaagtaagcctgccccagtaggagctatgttgaaaattttcaagaaaggatttaagggagattacagtgttactgtgataccaggaaaacttagaactttgtgtgaaatagactggccagcattagaggtgggttggccatcagaaggaagattggacaggtcccttgtttcaaaggtacggcacaaggtaacctgtaagccagggcacccagaccagttcctgtacatggacacttggttatagctggttttagacccccaccccacaatggttgagagaacagcagca

SEQ ID NO: 102 - DNA, 5617 bp, Homo sapiens
gtcaggcctctgagcccaagctaagccatcatatcccctgtgacctgcatgtacacatccagatggccggttcctgccttaactgatgacattccaccacaaaagaagtgcaaatggcctgttcctgccttaactgatgacattgtcttgtgaaattccttctcctggctcatcctggctcaaaagctcccctactgagcatcttgtgacccccgactctgcccgccagagaacaacccccctttgtaattttcctttacctacccaaatcctataaaacggccccaccccatctcccttccctgactctcttttcggactcagcccgcctgcacccaggtgaaataaacagccatgttgctcacacaaagcctgtttggtggtctcttcacacagacgtgtatgaaatttggtgccgtgacttggattgggggacctcccttgggagatcaatcccccgtcctcctgctctttgctctgtgagaaagatccacctatgcctcaggtcctcagactgaccagcccaagaaacatctcaccaatttcaaatcgggtaagccccctcttcttactctcttctgcaacctctctcactgtttctcagcctctttctcctttccactcttcaatctctcccttcttttaatttcaattcctttcattttctggtagagacaaaggagacacattttattggtggacccagaactccggcgctggtcattgactgggaaggcagccttcccttggtgtttaattattgcagggatgcctctttgattattcacccaggtttcagaggtgtcagaccacgcagggacgcctgccttggtccttcacccttagtggcaagtcccacttttctggggaaggggcaagtaccccaaccccttctctccgtgtctctaccccttctccacctttctggggggcaagaaacccccaaccccttctccttcacccttagtgacaagtcccgcttttctgggggaggagcaaataccccaaccttgtatctctgcaccccaatcccttatttccatgccccgacctcttatctcggtgccccaaccccttatttccacaccccaacccctttcccgcttttgtggagggcaagaaccccccaccccttctccgtgtctctattcttttctctgggcttgcctccctcactatgggcaagcttccaccttccattcctccttcttctcccttagcctgtgttcttaagaacttaaaacctcttcaactatcacctgacctaaaatcttaagtgtcttattttcttctgcaatgccacttgaccccaatacaaactcgatagtagttccaaatagccagaaaatggcactttcaatttttccatcctacaagatctaaataattcttgtcataaaatgggcaaatggtctgaggtgcctgacgtccaggcattcttttacacatcggtcccttcctagtctctgtgcccaatgcaactcgtcccaaatcttccttctttccctcccacctgtcccctcagtcccaatcccaagcgtcactgagtctttctaatcttccttttctacagacctatctgacctctcccctcctggccaggccgagctaggtcccaattcttcctcagcctcagctcctccaccctataatccttttatcacctcccctcctcacacccagtcaggcttacagtttccttccatgactagccctcccccacctgcccagcaatttactcttaaaaaggtggctggagctaaaggcatagtcaaggttaatgctcctttttctttatcccaaatcagatagcatttaggctctttttcatcaaatataaaaatccagcccagttcatgacttgtttggcagcaaccctgagacactttacagctctagaccctaaaatgtcaaaaggccgtcttattctcaaaatacattttattacccaatctgctcccgacattaaataaaactccaaaaattaaattccggccctcaaaccccacaacaggatttaattagcctcaccttcaaggtgtacaataatagaaaacagttgcaattccttgcctccactgtgagacaaaccccagccacatctccagcacacaagaacttccaaacacctgaaccgcagcagccaggcattcctccagaacctcctcccccagtagcttgctacaagtgccagaaatctggccaccaggccaaggaatacctgcagcccaggattcctcctaagccacgtcccatctgtgcgggaccccactggaaatcggactgtccaactcacctggcagccactcccagagcccctggaactctggcccaaggctctgactccttcctgggtcttcttggcttagcagctgaagactgatggtggctgatggcctcggaagccccctagaccatcacggatgccaagcttccagtaactctcacagtggagggtaagtctgtccccttcttaatcaatacggaggctacccactccacattaccttcttttcaagggcctgtttcccttgcctccataactgttgtggttactgacggccaggcttctaaacctcttaaaactccccaactctggtgccaacttggacaacactcttttatgcactcttttttagttatccccacctgcccagttcccttattaggccgagacactttaaccaaattatctgcttccctgactattcctggactacagctgcatctcattgccacccttctccccaacccaaagcctccttcgcgtcttcctctcgtatccccccaccttaacacacaagtatgggacatctctactccttccctggcaaggatcacatgcccattaccatcccattaaaacctaatcacccttaccccgctcaatgccaatatcccatcccacagcacgctttaaaaggattaaagcccgttatcactcgcctgctacagcatgggcttctaaaacctataaactctccttacaattcccccattttacctgtccaaaaactggacaagtcttacagattagttcaggatctgcgccttatcaaccaaattgttttgcctatccatcctgtggtgcccaacccgtacactcttttgtcctcaataccttcctccacaactcactattccgttctcgatcttaaagatgcttttttcactattcccctgcacccctcatcccagcctctctttgctttcacttagactgaccctgacacccatcaggctcagcaaattacctgggctgtactgccgcaaggcttcacagacagcccccattacttcagtcaagccgaaatttcatcctcatctgttacctatctcggcataattctcataaaaacacacgtgctttccctgctgatcatgtccgattaatctcccaaacctcaatcccttacaaaacaacaactcctttccttcctaggcatggttagtgcagtcagaattcttacacaagagccaagactgcaccctgtagcctttctgtccaaacaacttgaccttactgttttagcctagccttcgtgtctccgtgcagcagctgctgccactctaatactttcagaggccctcaaaatcacaaactatgctcaactcactctctacatttctcataacttccaaaatctattttcttcctcatacctgacacatatactttctgttccctggctccttcagctgtactcactctttgttaagtcccacaattaccattgttcctggcccagacttcagtccggcctcccacattattctggataccacacctgaccctcatgactgtatctctctgatccacctgacattcaccccatttccgcatatttccttctttcctgctcctcaccctgatcacgcttgatttattaatggcagttccaccaggcctaatcgccacacaccagcaaaggcaggctatgctatagtacaagtcactagcccgcctcttaaaacctctcatttcctttccatcgtggaaatctatcctcaaggaaataacttctcagtgttccatctgctattctactactcctcaaggattattcaggcccccctcccttccctacacatcaagctcgaggatttgcccccacccaggacttgcaaattagctttactcaacatgccccgagtcagataactaaaatacctcttagtctaggtagacactttcactggataggtagagtcctttcctacagggtctgagaaggccactgcagtcatttcttcccttctgtcagacataattcctcagtttagccttcccacctctatacagtctgatagcagaccagcctttattagtcaaatcagccaagcattttttcaggctcttagtattcagtgaaacctttatatcccttacagtcctcagtcttcaggaaaagtagaacagactaatggtcttttaaaaacacacctcaccaagctcagccaccaacttaaaaaggactagacaatacttttaccactttcccttctcagaagtcagacctgtcctcagaatgctacagtgtacagcccatttgaggtcctgtatagatgctcctttttattaggccccagtctcattccagacaccagactaacttagactgtgccccaaaaaaacttgtcatctctactatcttctgtctagtcatactcctattcaccgttctgaactactcatacatgctctgctcttgtttacactgccagtttacactgtttctccaagccatcacagctgatgtctcctggtgctatccccaaactgccactcttaactcttgaagtaaataaataatctttgctggcaggactatgctgaatttccttaggcactctctaattagatgtcctacgtcctcccaattcttagacctttaatagctgtttttctccttctcttattccgtttagtttttcaattcatacaaaactgtatccaggccattaccaataattctaaatgacaaatatttcttctaacagtcccacaatatcaccccttaccacaaaatcttccttcagcttaatctctcccactctaggttcccatgctgcccctaatcccactcaaagcaccctgagaaacatcgcccattgtctctccataccacccccaaaaattttcaccgccccaacactttaccactatttcattttatttttcttattaatataagaagacaggaatgtcaggcctcggagcccaagctaagccatcatatcccctgtgacctgcatgtacacatccagatggccggttcctgccttaactgatgacattccaccacaaaagaagtgaaaatggcctgttcctgccttaactgatgacattgtcttgtgaaattccttctcctggctcatcctggctcaaaagctcccctactgagcaccttgtgacccccactctgcccgccagagaacaacccccctttgactgtaattttcctttacctacccaaatcctataaaacggccccaccccatctcccttcactgactctcttttcggactcagcccgcctgcacccaggtgaaataaacagccatgttgctcacacaaagcctgtttggtggtctcttcacacggacgcgcatgaaa

SEQ ID NO: 103 - DNA, 991 bp, Homo sapiens
gtagggaaaagagagatcagactgttactgtgtctatgtagaaagggaagacataagaaactccattttgacctgtaccctgaaaaattgctctgccctgagatgctgttaatctgtaactgccccaacctctttgccccaaccttaagctcacaaaaacatgtgttgtatggaatcaaggtttaagggatctagggctgtgcaggatgtgccttgttaacaaaatgtttacaggcagtatgctcggtaaaagtcattgccattctccagtctcaataaaccaggggcacaatgcactgcagaaagccgcagggacctctgccctggaaagccgggtattgtccaaggtctttccccatgtgatagtctgaaatatggcctcgtgggatgggaaagacctgaccatcccccagcccgacacccgtgaagggtctgtgctgaggaggattagtaaaagaggaaagtcccttgcagttgagatagaggaaggccactgtctcctgcctgcccctgggaactgaatgtctcagtataaaacccgattgtacatttgttcagttctgagataggagaaaaaccgccctgtggcgggaggcgagacatgttggcagcaatgctgctttattattctttattccactgagatgtttgggtggagagaagcaaaaatctggcctacgtgcacgtccaggcatagtacctccccttgaacttatttgtgacacagattcctttgctcacatgttttcttgctgaccttctccccactatcaccctgctctcctactgcattcctcttattgagatagtgaaaatagtaatcaataaatactgagggaactcagagactggtgccggtgagggtcctccgtatgctgagcgctggtcccctgggcccactgttctttctctgtactttgcctctgtgtcttatttcttttctcagtctctcgtcccacctgacgagaaatacccacaggtgtagaggggc

SEQ ID NO: 104 - DNA, 7621 bp, Homo sapiens
tggatgagatgcaaagtaagcccactccattatggactgtgttaaagaatttccaaaaacattttaatggagattatggggttactatgaccccaggaagacttaggaccttgtgtgagatagattggccacattagaagtgggttggccatcagaaggaagcctacacagtccctagtctcaaagttatggcagaaggtaactggtaagccaggactcccaggccagtttccgtagacacttggctacagctggttttagactcgccacagtggttaagaggacaggcagcagcagtactagtggcaaaaggacagagagccaaggaagaatcccgctccacccgccgagagaagtcggctcctaaagtcctgtccgacccaacattagaggattcatggcaacaaacagcaccagtgcccacccgccccttcaccaagaaggaaggcctcccacccgagcttccacaaggcctacatacccctagaccacccagagtagaaaagaaaggatgcaagaccttggaagaaacctcgcccttggcagcccgtttgaggcctagaactgggatacaaaagcccctgaaagagcaacagtatactggggtagacgaggatggccatatggtggaaatgtgtgcctttgtgtaccaacccttcacctctgccagtctcctcaattggaaaaacaatacgtcatcctatactgaaaagcctcaagctataattgatttgctccaaactattacccagacccacaaccctacttgggttgattgccaccagttgctcatgtacctatttaactcagatgaaaggtgaagggtgctccaggcagcaactaagtggctagaggaacatgttctggctgattacccaaacccccaagagtatgtgaggatccaattaccaggaacagacccccagtgggacccaaatgaaagacagggtatgcaaaggctaaaccggtacagggaagcccttctggaaggcttaaaaaagagacctcaaaggccacaaatgttaacaaagtcattcaaggaaaagatagagtctggcacaattctatgagagactatgtgaggcctatcgtacatatactccctctgatcccgatagccctgaaaatcagcgcatgattaacatgactttggttagtcaaagtgcagaacacattagaagaaaactacagaaacaggctgggtttgcaggtatgaatacttcacagttattggagatagccaaccaggtgtttgtgaatagagatgcggtaagccacagagagaaccacagagagagcaaatgccaagcccagtgaaacgccgacctgctagctgcagctattagaggggttcccccgaaggagcaagagaaggggggcctggggaaaaatacccagtctggccatccatgcttgcagcgtaaccagtgtgcttactgtaaggaaataggacattggaaggacaagtgcccacagttgaaagggaaacaaggtggctctgagcaggaggcctcagacaaggacgaaggggccttgttcaatctggcagaagggttactggactgagggggaccgagctcatgtgaccccaaagagcccatggtcaggatgacagtcgggggcaaggacattgagtttcttgtcaatactgttgctgaacattcagtattaaccatcccggtcacccccttatccaaaaaaactattgatataatcggagccccaggggtttcggcaaagcaaactttctgtttgccccagacctgcactgtgtggggcatgaagcgattcaccagttcctgtacatggctgactgccccttgcctttactgggcaagggacctacttagcaagcggagagccactatctcttttacaaagcatggctctttacagctaaagttacctggaatgggagtcattgtgtttcttacggttccttgggaggaggaatggagactcttcttaactgagccaggccaagagataggaccagctctggctaagcggtggccaagggtgtgggtggaagacaaccctccaggtttggcaatcaaccaggcccctgtacttagaagctaagcctggggcccagccattcaggcaaaagcagtaccaggtccccagagaaaccattgagggcatccaggtccatctcaagcacctgagggcctttggaattatagtcccatgtcagtcccctcctacctgttcccaagccagggaccagggactacaggccagtacaggatttgtgcttggtcaaccaagctacagtgactttgcacccaacggtacctaacccatacacattgttggggttgctgccagctgaggacagctggttcacctgctttgacctaaaagactctttctttagtatcaaactagcccctgagagccaaaaactgtttgcctttcagtgggaggatctggggtcaggtgtcaccactcagtacacttggacccagctcccccaagggttcaagaactcccccaccatctttggggaggtgctggcttgagacctccagaagtttcccaccagagacctaggctgcgtgctgctccattaggtcaacgacctctgctgggacaccccacggcagtcgggtgtgccaagggaatgaataccctgctccagcacctagaagactgtgggtataaggtgtccaagaagaaagctcagattgcagacagcaggtacgttatctgggatttactatccgacagggagagcgcagcctgggatcagaaagaaagcaagtcatctgcaacctgtcagagcctaagaccagaaggcaggtaagagaattcttaggagctccagggttctgcaagttgcagatctcaaagtttgcagtattggctaagcccctgtacagagacacaaagcggggagacaaggaaccttttgaatgggagtcccaacagcaatgagcttttcatgagttaaaagagaagctcttgttggcctcagccctggggctacctgacctaacaaaaccttttacactgtatgtgtcagaaagagaaaaaatggcagttggagttttaacccagatgatggggctctggccaagaccgatagcctacctctccaaacagctagatggagtttctaaggttggcccccatgcttaagagccttggcagcaactgccctgttagtacaagaggcagataagctaactgttgggcaaaacctaaacataaaggccccccatgctgtggtaacactaatgaacatcaaaggacatcattggttaacgaatgctagactaactaggaaccaaagcttgctctgtgacaattcccgcataaccattgaagtttgcaacaccctgaaccctgtcaccttgctcctgatatcagagagcccagttgaacataactgtgtagaggtattggactcagtttattctagcaggcccaacctccgagaccatccttggacatcactagactgggagctatacatggaagggagcagcttcgtcaacccaaggagagaggtgtgctggatatgcagaggtaaccctggacggtgtcattgaagccaaattgttgccccagggtactttagcccagaaggcagaactcattgctttaattcaggccttagagctaagtgaaggtaagactaaacatttacactgactctaggtgtgcctttttaactcttcaagtgcatggggcattatacaaggaaaaaggcctattgaactctgggggacaagatgtaaagtatcagcaagagatcctgcaactattagaggcagtgtggaagccccaaaaggtggcagtcatgcactgcagtagacaccagtgagattctaccttgattgccttggggaactcccaagctgactcagaggctcaaaaagcaacatccacaccctaccgggcatcagtcacagcatcccctgctccctcaggaacctgaccttgtacatacttattctaaagaagagaagtactttctccaggcagagggagggcagatgatagaagagggatggatccagtaattggacagaagaatagctgtgccacaactgctaggagccaccgtcgtactggctgtgcatgagaccaccctcctaggccaagagtcacttgaaaagttgttaggccagtatttctaaatctcgcatctgtcagcccttgccaaaacagtggcgcagccatatgttacctgctggcagcacgatgctaggcaaggtccaaccattctgcccatcatacaagcttatggagcagcccccttggaagatctccgagtagacttcaccaagatgcccaaatgtggaggtaaaaagtatttgctagttctagtgtgtacgtactctgggtgggtggaggcctatccaacatgaactgagaaaactcgtgaagtaacccatgtgcttctccaagatctcatgcctaggtttggactgcacttacgaatcagcttggacaatgggccggcgtttgtggctgacttggtacagaagacagctaaggtattggggatcacatggaaactacataccgcctaccaaccacaaagttccggaaagggagcagatgaatcagactaccaaaacataatttagtgaaagtgtgtcaagaaacagggttaaggtgggtacaagctctccctgtggtattgtttaagattagatgtaccccttctaaaagaacaggctattctccttatgaaatattatatcataggccccctcccatactatggggactcccaggtactcctcgagacctaggtgaaattgagttacagagacagctacaggcttcagggaaaattacacaaacaatttcagcctgagtaaatgagagatgccccatcagcttattctccccagttcaccctttctccccagggtgtggatcaaggattagaacgtaacccccttgtggccatggtggaaaggaccccagactgtcgtcttgaccacagccataaaggtagagggaatcccagcctggatccaccacagccacgttaaacctgcagcacctgagacctgggaggtaagaccaagcccggacaacgcctgcaaagtgactctgaagaagacgacaagccctgctgcagtcacacccggaagctgactggtccacacacggccgaagcatgaggaaactcatcttgggactccttttccttaaactttggacttatagagtaaggacttcaactgaccttcctcagactgaggacaattcccagcatatatatcaagtcactgagataggacaaaaggttgctgtagtccattattttatagttattatgagtgtaccgggactctaagaggaacttgtttgtataatgctactctatacaaggtatgtagcccaggaagtgaccagcctgatgtgtgctctaacccatctgagcctcctatgactaccatttttgaaataagattgaggactgggagctggggaaaagctgatatgagtagagtagtaactagaatagaagagaaaggagtccccaaacaaattttcttaaaatttgatgcctgtgcagcaatcaacagtgacctgtatggaaatagaataagatgtagctctctagattgggaaaggggctatatagtagaaaataagtatgtttgtcatgaattaggactatgtactgatgaatgtagttactggtcctgtgttatttaggccacctggaaaaaaatatgagaaggaccctgtcctccttcaaaaaggaaagagtaactcttcatgcacttgtggttactgtaacctattagaactactaattaccaatccccttgatccccattggaaaacaggagagtatgtaaatttaggaatcaatggaactggactggatccctgagtaaatattttagtccaaggggaggtccacaggctctctcccaaaccagtgtttcagacattttatgatgagctgaatctgccagcaccagagcttccacaaaaaagaaaagaacttgtttctccatttagcagaaaatgtagctcatttcctcaatgttacttcctgttacatatgtgggggaaccactatgggagaccgatggccttgggaagcccgagaattggtgcctactgatccagttcctgacataattccagtccagaagacttctgggtcttgaaaacctctattactgaacaatactgcatagctagggaatgaaaagacttcaccatccctgtaggaaggctcaattgtctaggacagaggtctaggacagaggctgtataacggcacaacagggacagtcacctggtggggtctaaaccatactgaaaagtatgtaaatttccttcattacattccttcagtaaatttcctaaattacagattgcttggcccatccacaatctcatcgagactggacggctcctactggactatactggatatgtaggcacagagtctacactcagttacctgatcaatggccaggtagttgtgtcattggcaccagtaagccatccgttttcctactgcccgttagaacaggtgagctcttaggtttccctgtctatgtctcccgagaaaagaggagcatagctataggaaattggaaaggtgatgagtggcccccccccgaaaggatcacacagtactataggcctgccacatgggcacaagatggcttgtggggatactgagcccctatctacatgctcaactggatcatactgttacaggccatcttagaaataatcactaaagaaactggcagagctttgactcttttagcccagcagaaaccccaaatgagaaatgccatctagcagaatagattggccttagactatttgctggcagctgaaggaggagtctgtggaaaattcaacttgaccaattgctgtctgcaaatagatggtcaaggacaagtagtcgaaaatatagttagagacatgacaaagctggcacatgtacccatgcaggtttggcatgggtttgatccttgatccctgtttggaaaatagtttccagctctaggaggatttaaaacttttataataggaataataatagtgttaggaacatgcatgttactcccctgtatgttacccatatttctaccaccttagttcatcaaaagacctcagcacaagtatattacatgaatcactatcgatatgtctcacaggaagatctagatagtgaggatgagaatgagaactcccactagtgtgtgaggttctcaaagaggggtattaggagacaagccatttctcctactgtcccctgtatccaaagaaaaggaggaagtaaaaactgaaaaataacagactgatcagtgccactggccaggcctgtaggttaaagattaaccccaccctaactgcttgtgctatctatagatcacagataatggtatggagaaatacttgccttgctcaccacccccacctagtcatgtaccacatgcttgctcaatatatcgtgaccctttcacgtgaaccccttagagttgtaagcgggaactctttttttggggagttcagttcttgagacacaagtctgccaacactcctggccaaataaagcctcttccttctttaacccggtgtctgagggcatttgtctgtggctcgtcctgctaca

SEQ ID NO: 105 - DNA, 7718 bp, Homo sapiens
gtaggagattggtcagggtggtgggaaaagttataaggagagacgcaaaccttcttggaagtcctgggaggttttgcaaagcttcgggagagaataaaggctgaaggcagctaaattctcttaccctgaggctaagggcaagtagtaggtaacaaaggagtgtaaaggaatttatctagataagtttatttacttttgccgacctttgatcatccgacctttgatcatccgacctttgatcatctgacctttgatcatctgacctttgatcatccgacctttgatcatctgacctttgatcatccgcgtgcaggactgctccctacaggcgggggcaacaactacccacagattgtgttggctccaggcctttgtcattaaatctgtactaaataaatacaagcagctccagcttattggggctgcgttctctcttcggcgtctctaaggccgagcagtttcctagctgcgctcacgcaaaatacctgtgtctgcgtacttttttcatccgtcgctcggccagagtcggtggatcagactcagcagctggtgcccctcgtgaggaacactgcaagggatcacgacggaacccccgaaaatgaaggcgaagagactgtgcagtcagtaagtcattggtgcccactcgggatatccaagttcaggggaattctcagactagagtttcatcatgagacaacagctgtccgcacaacagaaacagtatataaaagtattgaaacaactgcttaaagctagcagagcctcggtttcacaggctcagttaagggtcctaaggcaaactgttgtttcccataatccatggttcccagcagaaggcatgctggacctagagctctgggaataagtggggagaaatcttaaacaataccataaacaagggcaacgggtcccagtaacatctttaaccttatgggccttagttagggctgctttggccctgctgtacacagaagatcccaagaagggaagggagaaggaaccatcacctaccttaccgccgcctcctcttccctcagccctgccattactgggtaaagataccaaagaggaaacagaggttttccctgagccccctcccccaataaattggaaaaaagacaagggatacactacagctgtgggaccctgtcttaggcaagtggcattagaaggggagctcttaacctgcccggtaatgcaagatcagcaaggtactcaggtatatgaacccatttcttttgacgcttataaagataagaaaaagcatcagagcaaacggagctgctagtccatttatgaaaggattaattgaagccatagcagacaacttctgtttggccccatgggactggtcagtgctagctaaaacaactttagagcccagtcagtacctcctctggaagacagagtatgatgagttgtatgaacaacaagccaaccagaatcaattggccgggcaaaacataacagctgctatgcttcaggggaggggttcctatgccagtgtccaacaacaattaagttttgttccctaagcctatgcacaagtgtctttgtgtgctatgagggcttgggactgaattcccgaattccgaaagcggaagttcaacaaggatctttataaatgttcgacaagggcctcaggagccattttttgaatttatcaatcggttaacccaggcaattaagagacaaattagtcatccccaggccgctgataatcttattgttgcagttggcttatgaaaatgctaacgtcgactgccaacaagcaatgcaggcagtcagaggaaaggcagttacggccagggaacttacacgagcacgtcaactggtggggactgaaacacacaaagccaaaatattggccatggcaataaagtctcctgaagtgaaaagggagaaaaccccaaattgttttctgtgtggagagccaggtcataagaagaggcagtgccccactagtagagaccaaggtaactcagcaaaagaacccccttctatatgcccccgacgtagaaaggggaaacgttgggcaaatcagtgcaagtccaaatttgataaagatgccaaccacctaagtaatcaggtgggaaacttcatgaggggccagccccaggccctgctccaaacttgggcaatgccagcggctttcctcggtcaattggaaagcccacagtccactctctcagaacagccacctctgggagcgcaggattgggcttactctgccccaacgaattagtgctaaaaggagaagaccctaaaaggattgcaacagggatctggggcccactgcctccagaacagtgggattggtcctaggatgatcaagcctatccagcaaaggaattaatgtgctcaccagggtaattgatagtgattatcaagattgaggtattagttatgatggagtgtaaaggtctgcatattcttccccctaaatctaaaatagctcagttactattcttaccgtactgggtccccaatgcccagggaaagaggaagggaagttttggaagcacgggagccgtaggagtgtattggaaccagttaatcactgatcagagacccatgattaccttaaaaatcggaaataagaattttactggcttataggatacaggggtgaatatttcgattattagttatcaaaactggtcagaaacttggccttgggtcactcagaaacaaaaaattgtcagcactggctaagtgcacacagccaagcagagcacacaccccctaacgttgtgatttggagggaaaaaacagttagcaactctaaacatgactgtccctgttaacctttggggacgggaccgattagcccaatgggggctgcaaacccctttctaataatggccactgttgttattcttcccctacccctgacgtggttctctcaagatccaatttgggtagcacagtggcctttaaagggagggaaataacagtgagcccatgagttagttcagcaattaaaagccagccatatagaaccatcaagcagcccttagaatttgcccattttcatcattcccaaaaggtctgggaaatggggacttgcatgacttacgggctatcagtggcagtttgcaacctatggggccccttcaacggggctcccttcccctgtggcaattcttcaagataggcctatagtcgatattgacttaaaagactgctttaatactattccccttgcagaacagggcagagaacaatttacatttaccatactagctatcagtaatgaaagggcagcttgccaatttcattggaaagtacttcctcaaggaatgctgaacagtcctaccatgtgtcagcatcatgtaaatcaggctttgctccccagtagaaaaaaatttcctaattgcaagattattcattttgtagatgatattttactagcagacccaacagagccaatacttttgagtttatatgcctctgtcgttaagatgttaatcatagcacctgaaaaagtacagatgtcctcaccttggaaatatcttaggtacatactaacttcctggtcagtaagacctcaaaaggttaaattaaatactagcaacttacataccttaaatgattatcaaaaattactgggtgatattaactggcatccccccaccttgggcataactactgataaattacagaacctgttttctatcctaaaaggcagtgctgccctagactcacccaggtatttaacccccgcagcaaaaagggaaattgaggaaatagaccaagttatttctcagagacaactagatagcatagatccacgatattcagttcagttgtttgtttttcctgctaaacactcctctacaggattaataggacagatggccacagggctgcgcttcctagaatgtgttttttgctcacatactgggactaaaacactatttggctatatccagctagttagtaaagtcatctatatgggctgcagacgatgcaatctgtggctgggttatgaccctgaatgtcataagaattttcttgagtagaaattcgaagtagtcttgctccatctctagattttcaattagcactctttgattatgcaggccatataaaatatgcccttcctgctggcagactatttcagttcttatctcatactcctctagttttgccaacaaaagtagttcactccctcatacctaaagctttaacgctttttactgatggctctggtaaaaatggaaaagcggctatttggtggaaaccacataattccctcactcaatctggatttactaccgctcagggagctgaggttggagccctagtactggccctagaaaccgaatccgttcagcccattaacattgttagtgactctgtttgtttgttgcaaaaccttgagaccgccctcattaagtccactctcgagcctaccctgtgtacaccttttcttggacttcagcaattgctgggtcaacatacacagttttatcacacatattcgagcacacagctcactgccttgcccactggcttatggcagtgatcaagcagacctgcagcttatgacgtcactgcttgaccaagccacccagtcgcttcagtttttccaccaaaattagagaaacttaacaatagcagcttacccaaagactgggtaaacaaattatcctgcagtgcccagattgccagctcacaggcacatctcttccttgaacaggtgttaaccttagaggactagaaccttatccattatagcaacagatgttacacacgtccctaaatttggaatactaagatatgtacatgtatccattgataccagttcctacctaattagcgcacatgctcttcctggagagtccacacgatacatcattaaacatcttttaacttttgcgtttatggggtggcccacaaaaattaaaactgataataatctggcctgtgccagctcacatattcaacaattttgtcacacatggagcatccaacattccacaggcatcccgtataactgacaggccatagtagaacgtgcccactccacccttaaaaatatgctcagaaaacaaaaaggggaaaatgagtaaggaccctgcaacactactagcacaagtgttatttacccttaatttctaaaatttaaatgataaatttcaatcaactatagaaaagcaccttgctaaaacctctcaagacataaaacccgcagttttatggaaagatgtaaatagtaacgtatggtgtagtccaaatgaattgctaacgtggggaagatgatatgcttgtgttcacacccccctcaggccctctttggattccagtacgatgcatcagaccataccatggcgtggctaggacccaacacagtaccagaagtgaaggaaatgatcctgcaggacccgcagctccagacaacacagcttcctcagacgacacaagccccggacattacctgggggatgctgaagaagacaacttacaaggctgagcaaatcctgctccagacacagaaaccattcactccagataatttgttccttgctctgctctctggtgtaagttacaactcacgtaggatcctttttatgctctcgcttcccctgcaacccgtaccggctacactctattgggctcatctgttagatccgcctttcttacgccctgttacctgggcaggcacccccttcccagcctctaataacgttaactgcttggctaggagggattgacttatcccagtagggtccgttattaatggcacacattggactaaggtgccaggtaacactacatatcactccattatcttcccactgtgtgtaaggttactatgtacctgccgaaacacaattatggctacaaatggcaaaggaattgccttaacattcttgtgccagtagcctcaaaccgggcaaggcaatcagtgccactttccccagcattcttccctgtgctaaagaacaaagccaggaaagtaatggattccactttggttgggaggtctgtcacgggggacaagcccttagtctccagttaggcaatttaacatcttagactggagcccccacggtcatttacagggcgaccatactgatgtttgcatccattgtggtgtcaatcttagtttcatagccatgtccgttcccctgtgatttgggccaaaggggggatgggatatcccagaccccaagtagagtccttgccaccccaagacacttaatggcatctgggacatcttagcaccacccttaacacctggcatgggacataacataattccagtaacaattatactatgacctttatgcataatcacacagatcagtgcctgatttgcactacccatccatatgtttttcttatgggaaccagtatttccattacacctcaaaactccatgtttgtgacctgagtgcaaggacaggcttgcttcacctcatgtatcattaattacaatatatctaatttaaatattactagtattatggtattaaggagacaatctgaggcattcctaccagtcagtttgatacacgattggcaaggttcctttgctcttgccaccttagaacatgccctgtcccaggtcagacaccaaagattcatagttaatcttacagcctttatagtctcagccatagtcatcctagcaactgctagttttgctgtagcatctattactgaatcagtacaaatagctgcttttgtagataacttggccagaaatgtgtctaatgaacttctcttacagcagggtacaaatcaaaaggttcttgcacatctgcaagccctcgaggctgccttggaacatgtaggggagtgacaagatgcgctggcattctgacagcaattaaactgtgactgggagcataagcatatctgtgtcacctctctaccatggaaccaatcaatacatagttgggatgaggtgaaacaacacctcggggtgaccttacatgataatttaacagcagacgtaaagcaacttaaaactaaaattctagaatccctaaacgccatagatctacatgtccaacaaacagttatatggaaggatgtgcaagaacatctctcctggatagaccctcactccttgattggaaaaaaatattactaattatactcatgtttgtcttatgttatttactaattctaggatgcaaagccggaatacgagcagtaatcgctacgcctgacaaacctgctgctgtgcacatctgtactcttcaatcaacaaaacctgatgcaaaaaacaaaagggggagatgtaggagatcagtcagggtggtgggaaaagttataaggagagacgcaaaccttcttggaagtccaggaggttttgcaaagcttcgggagagaataaaggctgaaggcagctaaattctcttaccctgacgctaagggcaagaagtaggtaacaaaggagtgtaaaggaatttatctagacgagttttatttacttttgcagacctttgatcatcctattgcgcgcaggactgctcccaaggcggtgggggtgacaattacctacagattgtgttggctccaggcctttgtcattaaatctgtactgaataaatacaagcggctccagcttatcagggctgcattctctctttggtgtctctaaggccgaacagtcccctagccgcactcatgcaaaatacctgtgtctgtgtacttttttcatccgtcgctcagcctgagtctgcaggtcagacttggca

SEQ ID NO: 106 - DNA, 90 bp, Homo sapiens
tcaccaccatcttggaagcagcacaccgccatcttggaagtggcctgccaccatcttgggagctctgggagcaaggatcccccggtaaca

SEQ ID NO: 107 - DNA, 7806 bp, Homo sapiens
gagagacaggactagctggatttcctaggctgactaagaatccctaagcctagctgggaaggtgaccacttccacctttaaacacggggcttgcaacttagctcacacccaaccagatagtaaggagaactcactaaaattctaattaggcaaaaacaggaggtaaagaaatagccaatcatctgttgcctgagagcatggtgggagggacaatgatcgggatataaacccaagcattcgagccagcaatggcaaccccctttgggtcccctccctttgtatgggagctctgttttcactctatttcactctattaaatcttgcaactgcactcttctagtccatgtttgttacgtctcgagctgagcttttgcttgccgtccaccactgctgtttgccaccgtcgcagacccgccgctgacttccatccatccagaggatccagcagggtgtctgctgtgctcctgatccagcgaggcgcccattgccacttccaattgggctaaaggcttgccattgttcctgcatggctaagtgcctgggttcatcctaatcgagctgaacactagtcactgggttccacggttctcttccatgacccacagcttctaatagagctataacactcaccgcatggcccaagattccattccttggaatccatgaggccaagaaccccaggtcagaaaacacaaggcttgccaccattttggaagtggctcaccaccatcttgggagctctgggagcaaggacccccaggtaacattttggcgaccacaaagggacatccaatgtggtgagaaatattagaccacttttgcttgctattctgtcctatccttccttagaattggaggaaaataccaggcacctgtcagccagttaaaaatgattagtgtggccaccagacttaagactcaggtgtgagcctatctggggaagggctttctaacaacccccaacccttctgggttggggacattggtctgcctggagccagctgccactttcaattttcttggggaagccaagggctgactacaggcagaaagctgtcatcccaaactcctggcagtagccggatgagatcatggtacagccagaagtctctactcaacagtcgcccatgcatgcgcccctacctttccttctgacccatacctcctgggtcccaaccatgactttcttgaaagtgtagccccaaaattatccttacctctgaatctacttcctctgatccctgcctcctaggtactaatggttcagactttcatttcctctagcaagttgtatctccaaagggatctaaggaagctacgctgtgtccttaggcacccaggctataacccagggagttttatccctggagtccctcccgatttaggtatacagctctcaacatgggcagttatgggggacccgttccccaccacccttgccagggccccaagcttgtaatggctaagagagagacgcggagggagagggagagagagagagagagagagagagagatggagagagagagagacagagagagagacagacagagaggtaaagagggagtgaaagagtaaaagataaaaatagtaaaaaaaacagtgtgccctattcctttaaaagccagggtaaatttaaaacctataattgataattgaaggtcttctccatgaccctataacactccaatgccactttgttgtcagtgtaaatcagggcgtagcccaaaagcactgaggccactgacaacccatagccttcctatcaaaaatccttaaccagttacccgcggatgggccaaatgcattcagtcggtagcagcaactgctttgctaaaagtggaaaagtacttttagaggaaacctcattgtgagtacacctcacgagttcagaattattctaagtcaaaaaagcaaaaaggtagcttactaactcaaaaatcttaaagtatggggctactatgttagaaaaaggcaatgtaactccaaccactgataattcccttaacccagcagatttcctaacaggtgatttaaatcttaattaccatacaaaggtccaaccagacctaggaggaactgccttcaggacaggacgatagatggtgattgaggaaaaaaaccacaattggtattcagtaattcatgcggagacttgtggaagcagagttacaaaaattgcctaataattggtctcctcaaacgtgtgagctgtttgcactcagccaagtcttaaagtacttacaaaatcaaaagactatctcaatcctgactcaaaagatttgctacaccttctctgaaatgaatttgcataagaactgttgtttatgggaatgcctcttgaaggggcagctggcttgttatgaaatactcaggaacccatcccagctctaggacttacccctgagcacaaaggcaatgttgggcatgctggtaaaggaccactggaatccagcagcccaaacccctttctttgtggttaagaaaggcaggaaaacagatgcaggattgctacattggtgagtgtaactaatccgataagcagaggtccatgggtggttacgcaccctggaaaggaataagcattacgaccatacaggatgctctagaaaatgctcactggaaaatgactaggggtactggcatccctatgttcttttttcagacagaaaacattccccccaaggcaaaaacacccctaagatgtattctggagaattaggaccaatttgacccttagacgctaagaaagtaatgacttacattcttctgcaataccgcctggccatgatatcctcttcaaggaggagaaagctggcctcctgagggaggtataaattataacaccatcttacagctagaccccttttgtagaaaagaaggcaagtggagtgaagtgccatatgtacaaactttcttttcattaagagacaacttgcaattatgtaaaaagtgtgatttatgccctacaggaagcccccagagtctacctccctaccccagcatccccctgattccttccccaactaataagaacccccccttcaacccaaacagcccaaaaggaggtagacaaaggggtaaacaatgaaccaaagagtgccaatattccccaattatgccccctccaagcagtgggaggaggagaattcggcccagccagagtgcatgtacctttttctctctcagacttaaagcaaattaaaatagacctagataaattctcagataaccctgatggctatattaatgttttacaagggttaggacaatcctttgatctgacatggagagtcataatgctactgctaaatcagacactaaccccaaatgaaaaaagtactgccacaactgcagcctgagagtttggtgatttctggtagctcagtcaggtcaatgagaggatgacaacagaagaaagagaatgattccccacaggccagcaggcagttcccagtgtagactctcactgggacacagaatcagaacatggagattggtgccgcagacatttgctaacttgcgtgctagaaggactaaggaaaactaggaagaagcctgtgaattattcaacgatgtccactatagcacagggaaaggaagaaaatcctactgcctttctggagagactaagggaggcactgaggaagcatacctccctgtcacatgactctattgaaggccaactaatcttaaaggataagtttatcagtcagctgcagacattaggaaaaaacttcaatagtctgccttaggcccagagcaaaacttagaaaccctactgaacttggcaaactcggttttttataatagaggtcaagaggagcaggcggaacgggacaaacgggactaaaaaaaaggccaccgctttagtcatggccctcaggcaagcggactttggaggctctggaaaagggaaatgctgggcaaatcaaatgcctaatagggcttgcttccagtgcggtctgcaaggacactttaaaaaagattgtccaagtagaagtaaggtacccccttgtccataccccttatgtcaagggaatcactgaaaggcccactgccccaggggacaaaggtcctctgagtcagaagccactaaccagatgatccagcagcaggactgagggtgcccagggcaagcaccagcccatgccgtcaccctcacagagccccaggtatgcttgaccattgagggccaggaggttaactgtctcctggacactggtgcggccttctcagtcttactctcctgtcccggacaactgtcttccagatctgtcactgtctgaggggtcctaggacagtcagtcactagatacttctcccagtcactaagttgtgatgggggagctttactcttttcacatgcttttctaattatgcctgaaagccccactcccttgttagggagagaaattctagcaaaagcaggggccattatacacctgaacataggagaaggaacaccactttgctgtcccctgcttgaggaaggaattaatcctgaattctgggcaacagaaggacaatatggatgagcaaagaatgcccatcctgtcgaagttaaactaaaggattccgcctcctttccctaccaaaggcagtacctccttagacctgaggcccaacaaggactccaaaagattgttaaggacctaaaagcccaaggcctagtaaaaccacacaatagcctctgcaatactccaattttaaaagtacagaaacccaacggacagtggaggttagtgcaagatctcaggattatcaatgaggctgttgttcctctatacccagctgtacctagtccttatactctgctttcccaaataccagaggaagcagagtgatttacagtcctgtaccttaaggatgccttcttctgcatccctgtacatcctgactctcaattcttgtttgcctttgaagatccttcaaacccaacgtctcaaatcacctggactgttaccccaagggttcagggatagtccccatctatttggccaggcattagcccaagacttgagcccattctcatacctggacacccttgtccttcggtatgtggatgatttacttttagctgcccgttcagaaaccttgtgccatcaagccacccaagcgctcttaaatttcctcactacctgtggctacaaggtttccaaaccaaaggctcggctctgctcacagcaggttaaatacttagggctaaaattatccaaaggcaccacagccctcagtgagatgtatccagcctatactggcttatcctcaccccaaaaccctaaagcaactaagacggttccttggcataacaggtttctgccgaatatggatttccaggtacagtgaaatagccagaccattatatacactaattaaggaaactcagaaagccaatatccatttagtaagatggatacctgaaacagaagcagctttccaggccctaaagaaggccctaaccaagccccagtgttaagcttgccaatggggcaagacttttctttatatgtcacacacaaaaaaacaggaatagctctaagagtccttacacaggtccaagagatgagtttgcaacccgtggcatacctgagtaaggaaactgatgcagtggcaaagggttggcctcattgtttacaggtagtgacggcagtaacagtcttagtatctgaagcagttaaaataatacagggaagagattttactgtgtggacatctcatgatgtgaatggcatactcactgctaaaggagacttgtggccgtcagacaaaagtttacttaaatatcaggctctattacttgaagggccagtgctgcaactgcgcacttgtgcaactcttaacccaggcacatttctttcagacaatgaagaaaagatagaacataaatgtcaacaagtaattgctcaaacctattccgcttgaggggagcttttagaggttcccttgactgattccgacttcaacttgtacactgatggcagttcctttgtagaaaaaggactttgaaaagcggggtatgcagtagtcagtgataatggaacacttgaaagtattcctctcactccaggaactactgctcagctggcaaaactcactcgggccctagaattaggagaaggaaaaagggtaaatatatatacagaatctaagtatgcttacctagtcctccatgcccatgcagcaatatggagagaaagggaattcctaacttctgagggaacacctatcaaacatcaggaagccattagggaattattattggctgtacagaaacctaaagaggtggcagtcttacactgccagggtcatcagaaaggaaaggaaagggaaatagaaaggaactgccaagcggatattgaagccaaaatagccacaaggcaggaccctccattagaaatgcttatagaaggggactcctagtatggggtaatcccctccaggaaaccaagccccagtacccagaagaagaaatagaacagggaacctcacgaggacatagtttcctcccctcaggatggcaagccaccgaagaaggaaaaatacttttgcctgcagctaaccaatggaaattacttaaaacccttcaccaaacctttcacttaggcattgatagcacccatcagatggctaaattattatttactggaccaggccttttcaaaactatcaagcagatagtcggggcctgtaaagtgtgccaaagaaataattcccttcactgcaggccatacatttcaatccctgcatctttaacctccttgttaagtttgtctcttccagaatcgaagctgtaaaactacaaattgttcttcaaatggagccccagatgcagtccatgactaagatctactgcggatccctggactggcctgctagcccatgctccaatgttaatgacatcgaaggcacccctccctaggaaatctcaactgcacgacccctgctgcgccccaattcagcaggaagcagttagagcagttgttggccaacctcctcaacagcacttgggttttcctgttgagagggggtactgagagacaggactagctggatttcctaggctgactaagaatccctaagcctagctgggaaggtgaccacttccacctttaaacatggggcttgcaacttagctcacacccaaccaatcagatagtaagaagaactcactaaaatgctaattaggcaaaaacaggaggtaaagaaatagccaatcatctgttgcctgagagcacggtgggagggacaatgattgggatataaacccaggcattcgagccagcaatggcaaccctctttgggtccgttccctttgtatgggagctctattttcactctatttcactgttaaatcttgcaactgcactcttctagtctgtgtttgttacgacttgagctgtccaccactgctatttgccactgtcgcagacccaccgctgacttccatccctccagatctggcagggtgtctgctatgctcccaatccagccaggcacccattgccacttcagatcgggctaaaggcttgccattgttcctgcatggctaaattcctgggttcatcctaatccagctgaacattagtcactgggttccatggttctcttcagtgactcacagcttctaatagagctataacactgaccgcatggcccaagattccattccttggaatccatgaggccaagaaccccaggtcagagaacacgaggcttgccaccatcttggaagtggcccactaccatcttggaattggcccaccaccatcttgggagctctgtgagcaaggacccccagtaaca

SEQ ID NO: 108 - DNA, 5361 bp, Homo sapiens
gtcaggcctctgagcccaagccaagccatggcatcccctatgacttgcacgtatacatccagatggcctgaagtaactgaagatccacaaaagatgtaaaaatagccttacctgatgacattccagcattgtgatttgtttctgccccaccctaactgatcaatgtactttgtaatctcccccacccttaagaaggttcttcgtaattctccccacccttgagaatgtactttgtgagatccatccctgcccgcaaaacattgctcttaacttcaccgcctatcccaaaacctataagaactaatgataatccaccacaccatttgctgactctcttttcggactcagcccgcctgcatccaggtgaaataaacagccatgttgctcacacaaagcctgtttggtggtctcttcacatggacgcgcatgaaatttggtgccatgactcggatcgcgggacctcccttgggagatcaatcccctgtcctcctgttctttgctccgtgaaaaagatccacctacgacctcaggtcctcagacccaccagcccaaggaacatctcaccaattttaaatcaggtaggcggcctcttcttactctcttctccaacctctctcactatccctcaaccactttctcctttccactcttcaatctctcccttctcttaatttcaattcctttcattttctggtagagacaaacgagacacgttttatccgtggacccaaaactctggcgctggtcacagactgggaaggcagcctttccttggtgtttaatcattgcagggacacctctctgattattcactcacgtttcaaaggtgtcagaccactcagggacgcctgccttggtccttcacccttagcggcaagtcctgcttttctgggggaggggcaagtaccacaaccccttctctccgtgtctctaccccttctctgcatttctgggggaggggcaagtacccctcaaccccttctccttcacccttagcggtaagtcccgcttttctagggggcaagaacccccaatcccttatttccgcaccccgacctcttatctgtgtgccccaatcccttatttccacaccctgacccctttcctgcttttctggagggtaagaaccctcgaaccccttccctccgtgtctctactctctcttttctctgggcttgcctcctttactatgggcaaccttccagcctccattcctccttctcccttagcctgtgttctcaagaacttaaaacctcgtcaactcgcacctgacctaaaacctaaatgccttattttcttctgcaacaccgcttggccccagtacaaacttgacaatggctctaaatggccagaaaacggcactttcgatttctccatcctataagacctaaataatttttgtcaaaaaatgggcaaatggtctgaggtgcctcacatccaggcatttttcacacttcgttccctctcaagtctctgttcccaatgcgattcctcccaaatcctccttctttccctcccgcctgtcccctcagtcccaaccccaagtgtcgctgggtctttccagtcttttctacagacccatctgacctttccccttctcctcaggctgctcgtcgccaggccatctaggtcccaattcttcctcagcctctgctcctccaccctagaatccttttatcacctcccctcctcacacctggtccagcttacagtttcgttcagtgactggccctcccccacctgcccagcaatttactcttaaaaaggtggctggagctaaaggcatagtcaaggttaatgctcctttttctttatcccaaatcagaagcgtttaggctctttttcatcaaatataaaaatccagcccagttcatggctcgttcggcagcaaccctgagacgctttacagccctagaccctaagaggtcaaagggccgtcttattctcaatatacgttttattacccaatctgctcccgacattaaataaaactccaaaaattaaattccggccctcaaaccccacaacaggacttaattaacctcgccttcaaggtgtacaataatagagtagaggcagccaagtaacaacatatttctgagttgcaattccttacctccactgtgagacaaaccccagctacatctccagcacacaagaacttccaaacgcctaaaccgcagtggccaggcattcctccataactgcctcccccaggagcttgctacaagtgccagaaatctggccaccgagccaaggaatgcccgcagcccgggattcctcctaagcgagtcccatctgtgtgggaccccactgaaaattggactgttcaactcacctgacagccactcccagagcccctggaactctggcccaaggctctctgactccttcccagatcttctcggcttaacggctgaagactgacgctgcccgatcgcctcggaagccccatagaccatcacagatgccgagctttaggtaactctcacagtggagagtaagtccgtcctcttcttaatcaatacggaggctacccactccacattaccttcttttcaagggcctgtttcccttgcctccataactgttgtgggtattgacagccaggcttctaaacctcttaaaactccccaactctggtgccaacttagacaatactcttttaagcactcgtttttagttatccccacctgcccagttcccttattaggccgagacactttaactaaattatctgcttccctgactattcctgggttacagctacatctcattgctgccctttccaatccaaagcctcctttgcgtcctcctcttgtattcccccccaccttaacccacaagtataagatacctctactccctccttggcgaccgatcatgcaccccttaccatctcattaaaacctaatcacccttaccccgctcaatgccaatatcccatcccacagtatgctttgaaaggagtaaagcctgttatcacatgcctgctacagcatggccttttaaagcctataaactctccttacaattcccccattttacctgtcctaaaaccagacaagccttacaagttagttcaggatctatgccttatcaaccaaattgttttgcctatccaccccatggtaccaaaccatatactctcctatcctcaatacctccctccacaatccattattctgttctggatctcaaacatgctttctttacaattcctttgcacccgtcatcccagcctctctttgctttcacttggactgaccctgacatccattaggctcagcaaattacctgggctgtactgctgcaaggcttcacagacagcccccattacttcagtcaagcccaaatttcatcctcatctgttacctatctcggcataattctcatgaaaacacacgtgctctccctgctgatcgtgtccgattaatctcccaaacctcaatcccttacaaaacaacaactcctttccttcctaggcatggttagtgtgtcagaattcttacacaagagccaggaccgcaccctgtagtctttctgcccaaacaacttgaccttactgttttagcctagccctcatgtctgcttgcagtggctgccgctgctttaatacttttagaggccctaaaaataacaaactatgctcaactcactctctacatttctcataacttccaatattattttcttcctcatacctgatgcatatactttctgctccccggctccttcagctgtactcactctttgttaagtcccacaattaccactgttcctggcccggacctcaatctggcctcccacattattcctgataccacacctgacccccatgactgtatctctctgatccacctgacattcaccccatttccccatatttccttctttcctgttcctcaccctgatcacgcttgatttattgatggcagttccagcaggcctaatcgccacacagcagcaaaggcaggctatgctatagtacaagccactagcccgcctcttagaacctcatttcctttccattgtggaaatctatcctcaaggaaataacttctcagtgttccatctgctattctactactcctcagggattattcaggccccctcccttccctacacatcaagcttgaagatttgcccccacccaggactggcaaattagctttactcaacatgccccgagtcagataactaaaatacctcttagtctaagtagacactttcactaggtaagtagaggcctttcctacagggtctgagaaggccaccgcagtcatttcttcccttcggtcagacacaattcctcagtttagccttcccacctctatacagtctaacagaccagcccttattagtcaaatcagccaagcagtttctcaggctcttagtattcagtgaaacctttatatcccttacggtcctccgtcttcaagaaaagcagaacggactaaaggtcttttaaaaacacttcaccaagctcagccaccaacttaaaaaggactggacaatacttttaccactttcccttctcagaagtcagacctgtcctcagaatgctacaaggtacagcccatttaagctcctgtatagatgctcctttttattaggccccagtctcattccagacaccagaccaacttagactgtgcccccccccccaaaaaaaacctgtcatcatccctactatcttctgtctagtcatactcctattcaacgttctcaactactcatacatgccctgctcttgtttacactgctggtttacactgtttctccaagccatcacaggtgatatctcctcgtgctatccccaaactgccactcttaactcttgaagtaaataaataatctttgctggcaggactatgctgaatctccttaggcactctctaatcagatgtcctaggtcctcccaattcttagaccttttatacctgtttttctccttctcttattccacttagtttttcaattcatacaaaaccatatccaggccatcaccaatcattctatacgacaaatgtttcttctaacatccccacaagatctcccttcggcttaatctctcccactctaggttcccacgccgcccctaatcccacttgaagcagccctgagaaacatcgcccattctctctccataccaccccacaaaaattttcgctgccccaacacttcaacactattttgttttatttttcttattaatataagaaggcaggaatgtcaggcctgagcccaagccaagccatcgcatcccctatgacttgcacgtacacatccagatggcctgacgtaactgaagatccacaaaagaagtaaaaatagccttaactgatgacattccaccat

SEQ ID NO: 109 - DNA, 714 bp, Homo sapiens
tcacagtaggtagttaggcagacttgagcagggcaggagagggtcccctgaaccaggattatcaggcgaccatcaggtgatggtcaggcggttgtttgttaaactgcctctctaaaataataatgggttgcagccagcgtcagggaaaggcagtctcccaatacacagaaaacacctgaaactggtgatcagcagcttcccaataagatctcaggagttgagcaagtgggcttaagcatgcacactaagaggcaaaatggaggcgtttacccggtgtatgacctctagtgttcctctaggaacactctgctggtaacggaagaacctcaagtgatcatgagcacagcttcaataaacacactgcacgtgcagcccctcccaggtgctggcaggccaccgggcacacggacagcccaccccaagggaagaatcaggagagaagtaatgcaaccccctggaagcatgccaatgtatacaaccccaagtcaaaggtcaaatcgtcatgcacttgaatctctcaagtcgcccacttggctctcttccaagtgtactttacttcgttttgttcctgctgtaaactttttagtaaacttccactcctgctctcaaacttgcctccgtctctccctctgccttatgccccttgttgaattatttcttctgaagaggcaagaattgaggttgctgcatactcgtatgatttgctgctgctaa

SEQ ID NO: 110 - DNA, 724 bp, Homo sapiens
ttaccgaaggtagttggtcagacatacgcagggcaggagagagcgcccctggcccctacaaccccaaccagaaatatcaggcaacaatcactgatggtcaagcagtggttaaactgtttctctaaaataataattggttgcagccagtgccagggaaaagcagtatccccaatagatagaaacatctgaaactcatgatcagcagcttccgataacatctcaggagctgggcaagtgggttcaagcatgcacactaagaggcaaaatggtggagtttaactggtctatgactcctcctagggacatctggtaagagaagaatgcctcaagtgagtatgtacacaactctagtaaacacacagcacatgtggaaccccctctccctgtaagtgctggcagccactgtgcatgcggacagcccaccccaagggaagaatcaggagagaagggacacgaggccctggaagtatgccaacatataaaaccctaagtcaaaggtcgaactgtgctcttgaatccctcaagtcacccacttggccctcttccaagtgtactttacttcctttcattcctgctctaaaactttttaataaactcactcctgctctaaaacttgcctcactgtctccctctgccttatgccccttagctgaattctttcttctgaggaggcaagaattgaggctgctgtagacccatgtggatttgccactgctgaacaata

SEQ ID NO: 111 - DNA, 8055 bp, Homo sapiens
gtcaggcctctgagcccaagccaagccatcacatcccctgtgacttgcacatatacgcccagatggcctgaagtaactgaagaatcacaaaagaagtgaatatgccctgccccaacttgatgacattccaccacaaaagaagtgaaaatggccggtccttgccttaagtgatgacattaccttgtgaaagtccttttcctggctcaaaaagctcccccactgagcaccttgcgacccccactcctgcccgccagagaacaaaccccctttgactgtaattttcctttacctacccaaatcttatagaaacggccccacccctatctcccttcgctgactctcttttcagactcagcccacctgcacccaggtgattaaaagctttattgctcacgcaaagcctgtttggtggtctcttcacacggacgcacatgaaatttggtgccgtgactcggatcggggggccttccttgggagatcaatcccctgtcctcctgctctttgctccttgaaaaagatccacctacaacctcaggtcctcagacccaccagcccaaggaacatctcaccttatatctctgcgccccaatcccttatttccgcgccctgacctcttatctctgtgccccaatcccttatttccgtaccccgacctcttatatctctgtgccccgatcccttatttccgtgccccaacctcatatctctgcaccctgatcccttatttccgtgcaccgacctcgtatctctgcgccccaacccctttcccacttttctggagggtaggaacccctgaaccgcttccctccatgtctctactctcccttttctttaaacttgcctccttcactataggcaaccttccaccctccattcctccttcttctcccttagcctgtgttctcaaaaacttaaaacctcttcaactcccacctgacctaaaacctaaatgcttattttcttctgcaatgccgcttgacccaatacaaactcaacagtagttccaaatagccagaaaacggcactttccatttttccatcctgcaagatctaaataattattgtcgtaaaataggcaaacggtctgagctgcctgacggccaggcattcttttacacatcggtcccttcctagtctctgtgcccaaagcaactcgtcccaaatcttcctcctttccctcccgcctgtcccctcagtcccaaccccaagcgtcactgagtctttctttcttttctacagatccatctgacctctcccctcctccccaggctgctcctcgccaggccaagctacgtcccaattcttcctcagcctctgctcctccaccctacaatccttttatcacctcccctcctcacacctggtccggcttacagtttcgttccgcgcctagccctcccccacctgcccagcaatttcctcttaaaaaggtggctggagccaaaggcatagtcaaggttaatgctcctttttctttatccgacctctcccaaagcagtgagcatttagactctttttcatcaaatataaaaaacccagccctgttcatggcttgttcggcagcaaccctgagacgctttacagccgtagaccctaaaaggtcaaaaggccgtcttattctcaatatacattttattacccaatctgctctcgacattaaataaaactccaaaaattaaattccggccctcaaaccccacgacaggatttaattaacctcgccttcaaggtgtacaataatagaaaaaagttacaattccttgcctccactgtgagacaaaccccagccacatctccagcacacaagaacttccaaacgcctaaaccgcagtggccaggagttcctccagaaccaccttccccaggagcttgctacaagtgccagaaatctggccaccaggccaaggaatgcccgcagcccgggattcctcctaagccgtgtcccatctgtgcgggaccccaccggaaatcggactgttcaactcacctggcagccactcccagagtccctggaactccggcccaaggctctctgactgactccttcccagatcttctcggcttagcagctgaagactgacactgccagattgcctcggaagcctacaggacagagagctctaagtaactctcacagtggagggtaagtctgtccccttcttaatcaatacagaggctacccagtccacgttaccttcttttcaagggcctgttttcctcgccccgataattgttgtgggtatcgacggccaagcttcaaaacccctgaaaactcctcaactctagtgccaacttggacaacactcctttatgcacttttttatttatccccacctgcccagttcccttattaggccgagatattttaaccaaattagctgcttccctgactattcctgggctacagccacacctcattgccaccttttccccagttcaaagcctccttcgcatctccctctcgtatccccccccaccttaacccacaagtataagatacctctattccctccttggcgaccgatcatgcaccccttacaatctcattaaaacctaatcacccttacccccctcaatgccaatatcccatcccacagcacgctttaaaaagattaaagcctgttatccctcgcctgctacagcatggtcttttaaagcctataaactctccttaccattcccccattttacctgtcctaaaaccagacaaggcttacaggttagttcagaatctgcgccttatcaaccaaattgttttgcctatccaccccatggtgccaaacccgtatcctctcctatcctcaatacctccctctacaacccattattctgttctggatctcaaacatgctttctttactattcctttgcacccttcatcccagcctctcttcgctttcacttagactgaccctgacacccattaggctcagcaaattacctgggctgtactgccgcaaggcttcacagacagaccctattacttcagtcgagcccaaatttcatcctcatctgttacctatctcagcataattctcataaaaacacacgtgctctccctgctgatcgtgtccaattattctcccaaacctcaatcccttacaaaacaacaactcctttccttcctaggcatggttagtgcggtcagaattcttacacaagagacaggaccacaccatgtagcctttctgtccaaataacttaaccttactgttttagcctagccctcatgtctgcgtgcagcggctgccgctgctttaatacttttagaggccctaaaaatcacaaactatgctcaactcactctctacatttctcataacttccaaaatctattttcttcctcatacctgatgcatatactttctgctccccggctccttcagctgtactcactctttgttaagtcccacaattaccattgttcctggcccggacttcaatccagcctcccacattattcctgataccacacctgacccccatgactgtatctctctgatccacctgacattcaccccatttccccatatttccttctttcctgttcctcaccctgaccacgcttgatttattgatggcagttccaccaggcctaatcgccactcaccagcaaaggcaggctatgctatagtatcttccacatctatccttgaggctaccgctctgccccactccactacctctcagcaagccgaactagttgccttaactcaagccctcactcttgcaaaaggactacgtgtcaatatctatactgattctaaatatgcctttcatattctgcaccaccctgcggtcatatgggctgaaagaggtttcctcactacacaagggtcctccatcattaatgcctctttaataaaaactctgctcaaggccgctttacttccaaaggaagctggggtcattcactgcaaggggcatcaaaagtcatcagatcccattgctctaggcaacgcttatgctgataaggtggctagacaaacagctagctttccaacttctgtttctgacagcaacgcttatgctgataaggtggctagacaagcagctagctttccaacttctacctctgacagcaatgcttatgctgataaggtggctagacaagcaactagctctccaacttctgtccctcacagccagtttttctccttcacatcggtcactcccacctactcccctgttgaaacctccacctatcgatctcttcccacacaaggcaaatggttcttagaccaaggaaaatatctccttccagcctcacaggcccattctattctgtcatcatttcataacctcttccatgtaggttacaagccactagcccgtcccttaggacctctcatttcctttccatcatggaaatctatcctcaaggagatcacttctcagtgttccatctgctattctactacctaccccccagggattgttcaggcctcctccctttcctacacatcaagctcagggatttgcccccgcccaggactggcaaattgactttactcacaagccttgagtcagaaaactaaaatatctcttagtctgggtagacactttcactggatgggtagatgcctttcccacagggtctgagaaggccaccgctgtcatttctgcccttctgtcagacataattcctcggtttggccttcccacctctatacagtctgataacgggccagcctttactagtcaaatcacccaagcagtttctcaggctcttggtattcagtggaaccttcatatcgcttaccatcctcagtcttcaggaaaggtagaatggactaatggtcttttaaagacacacctcaccaagctcagcctccaacttaaaaaggactggacagtacttttacctcttgcccttctcagaattagagcctgtcctcgagatgctacagggtacagtccatttgaacttttatatggacgcactttcttgcttgggcccaacctcttcacagacaccagccctctaggtgactatcttccagtcctccaacaggctagacaggaaattccccagactgctaatcttctcttgcttactccagatccccagccatatgaagacaccctagctggatgatcagttcttgttaagaatctgaccccttaaactctacaacctcgatggaccggaccctacttagtcatctatagtaccccaactgctgtctgccttcagggtcctccccactaggttcaccattccagaataaagctctgtccatcggacagccagcctaatccctcctcttcctcctggaagtcgcaagtactctcccctacttcccttaaactcactcgtatttctgaagaagagtaataacccttatgagcctaatacatcccttcattctcttaggtctgtttgtccttaccctactttttgcaacagggctttacgaagtcacccccaccacttaggacgagccccaaaaaacttgtcatccctactattttctgtctaatcatactcctattctccgttctcaactacttacaaatgccctactcttgtttacactgccggtttacactgtttcttcaagccatcacagctgatatctcttggtgctatccccaaaccgccactcttaattccctcttagagtgggtagatgatctttgctggcagggcaccctccaatacttccaccctgatgaagttctattctttacttttatacttactcttattctcattcccattcttatgccaccctttacctctccccagctatctccaccacactatcaaccttacccattctctcctagccgcttctaatccctccttagtgaacaactgctggctttgcgtttccctttcttccagtgcctacacagctgtccccaccttacagacagactgggcaacatctcctgtctccttacacctctgaacctcctttaacagccctcacctttaccctcctgaagaactcatttactttctagacaggtccagcaagacttccccagacctttcacatcagcaagttgccgccctcctccgcacttatttaaaaaacctttctccttatattaactctactccccccatatttggacctctcacaacacaaactactattcctctggctgcccctttatgtatctctcggcaaagacccactggaattcccctaggcaatctttcaccttctcgatgttcctttactcttcatctccgaagcccaactacacacatcactgaaacaattggagccttccagctccacattacagacaaaccctctatcaatactgacaaactcaaaaacattagcagtaattattgtttaggaagacacttactctgtatttcactccatccttgactactttcccttgctcatcagactctcctcccaggccctcttcttgtttacttataccgagccccgaaaataacagtgaaaggttgctcgtagatactcaacgttttctcatacaccatgaaaactgaacctcctcctctatgcagttaccccatcagtccccattacaacctctgacagctgccgccctagctggatccctaggagtctgggtacaagacacccctttcagcactccttctcacctttttactttacatctccagttttgcctcgcacaaggtctcttcttcctctgtggatcctctacctacatgtgtctacctgctaattggacaggcacattcacactagttttccttacccctaaaatacaatttgcaaatgggaccgaagagctccctgttcccctcatgacaccaacacgacaaaaaaagagttattctactaattcccttgatggtcggtttaggactttctgcctccactattgctctaggtactgggatagcaggcatttcaacctctgtcacgaccttccgtagcctgtctaatgacttctctgctagtatcacagacatatcacaacttaatcagtcctccaggcccaagttgactctttagctgcagttgtcctccaaaacggccgaggtcttgacttactcactgctgaaaaaggaggactctgtatattcttaaatgaagagtgttgtttttacctaaatcaatctggcctggtgtatgacaacataaaaaaactcaaggatagagcccaaaaacttgccaaccaagcaagtaattatgctgaatccccttgggcactctctaattggatatcctgggtcctcccaattcttagtcctttaatacccatttttctccttcttttatttggaccttgtatcttccatttagtttctcagttcatccaaaactgtatccaggccatcaccaatcattctatatgacaaatatttcttctaacaaccccacaatatcaccccttaccacaagacctcccttcagcttaatctctcccactctaggttctcacgccacccctaatcccgcttgaagcagccctgagaaacatcgcccattctctctccataccaccccccccaaaaaattttcgctgccccaacacttcaacactattttgttttatttttcttattaatataagaaggcaggaatgtcaggcctctgagcccaagccaagccatcacatcccctgtgacttgcacatatacgcccagatggcctgaagtaactgaagaatcacaaaagaagtgaatatgccctgccccaccttaactgatgacattccaccacaaaagaagtgtaaatggccggtccttgccttaactgatgatattctaccacaaaagaagtgaaaatggccggtccttgccttaagtgatgacattaccttgtaaaagtccttttcctggctcatcctggctcaaaaagctcccccactgagcaccttgcaacccccactcctgcccaccagggaacaaaccccctttgactgtaattttcctttacctacccaaatcttataaaaacggccccacccctatctcccttcgctgactctcttttcagactcagcccgcctgcacccaggtgattaaaagctttattgctcacacaaagcctgtctgctggtctcttcacatggacgtgcatgaaa

SEQ ID NO: 112 - DNA, 467 bp, Homo sapiens
gcaggagttcagtcagggtggtgggaaaaaatgtagaaagatgcaaaccttggaaggccaaaaggttttacatcagtttcggaacaggatttggctgaaagcagccagattcttttatacggtgcctgaaagcttaggttagataacgggatgttaagaaactgatctagataagttacttagctcggaacctggcctttaatcattcgtaggactgctctctcctgggaggggaaccatgttaattatccacaagtgtgttgactcaaagcctttgccattatatctatactgaataaatgaccacagcaacagctagtcgggaccgcggctgctaactctttacagcaccctcctcagtgtctgtgggtggcccagccccctagctcactctttcactggatacctgtgtttgagtgcatttgttcatctgtcgctgggtcagggtctgcgggtcagacctggca

SEQ ID NO: 113 - DNA, 960 bp, Homo sapiens
gtggggaaaagcaagagagatcagattgttactgtgtctgtatagaaagaagtagacataggagactccattttattctgtactaagaaaaattcttctgccttgagattctgttaatctatgaccctacccccaacccggtgctctctgaaacatgtgctgtgtcaaactcagggttaaatggattaagggttgtgcaagatgtgctttgttaaacagatgcttgaaggcagcttgctccttaagagtcatcaccactccctaatctcaagtacccagggacacaaacactgcggaaggacccctgcctaggaaagccaggtattgtccaaggtttctccccatgtgatagtctgaaatatggccttgtgggaagggaaagacctgaccgtcccccagcccgacacccgtaaagggtctgtgctgaggaggattagtataagaggaaggcaagcctcttgcagttgagacaagaggaaggcatctgtctcctgcccgtccctgggcaatggaatgtctcagtataaaacccgattgtaggttccatctactgagatagggaaaaaccgccttagggctggaggtgggacgtgcgggcagcaatactgctttgtaaagcattgagatgtttctgtgtatgcatatctaaaagcacagtacttaatcctttaccttgtctatgttgcaaagacctttgttcacgtgtttgtctgctgaccctctccccactattgtcttgtgaccctgacacatccccctctcggagaaacacccatgaatgatcaataaatactaagggaactcagaggctggcgggatcctccatatgctgaacgctggttccctgggtccccttatttctttctctatactttgtatctgtgtctttttcttttccaagtctctcgttccaccttacgagaaacacccacaggtgtggaggggcaacccaccccttca

SEQ ID NO: 114 - DNA, 4487 bp, Homo sapiens
cttctcccttagcctgtgttcttaaaaacctaaaaacctctttaactcacgcctgacctaaaacctaaatgccttattttcttctgcaatgccacttgaccccaatacaaactcgacagtggttccaaatagccagaaaatggcactttcaatttttccatcctacaagatctaaataattcttgtcataaaatgggcaaaaggtctgagatgcctgatatccaggcattctttcacacatgggtccctccctagtctctgttcccaatgcaactcgtcccaaatcttccttctttccctcctgcctgtcccctcagtcccaaccccaagcatcgctgagtctttctaatcttccttttctacagacccatctgatctctcccttcctcgccaggctgagctaggtcccaattcttcctcagcctctgctcctccaccttataatccttttatcaactcccttcctcacacccagtccagcttacagttttgttccatgactagccctcccccacctgcccagcaatttactcttaaaaagatggctggagctaaaggcacagtcaaagttaatgctcctttttctttatcccaaatcagatagcgtttaggctctttttcatcaaatataaaaacccagcccagttcatggctcatttgtcagcaaccctgagaagctttacagccctagaccctaaaaggtcaaaaggccgtcttattgtcaatatacattttattacccaatctgctcccgacattatgtaaaactccaaaaattaaattccggccctcaaagcccacaacaggacttaattaacctcaccttcaaggtatacaataatagaggcagccaagtagcaacatatttctgagttgcaattccttgcctccactgtgagacaaaccccagccacatctctaacacacaagaacttccaaacgccgaaaccgcagtggccaggcattcctccaggcccgcctcccccaggagcttgctacaagtgccagaaatctggccaccaccaggccaaggaatgcctgcagcccaggattcctcctaagccacgtcccatctgtgtgggaccccactgaaaatcggactgttcaactcacctggcagccactcccagagcccctggaactctggcccaaggctctctaactgactcctttccagatcttctcagcttagtggctgaagactgatgctgcccgatcacctcggaagccccctagaccatcacggacgccgagctccaggtaactctcacagtggagggtaagtccgtccccttcttaatcaatacggagactacccactccacattaccttcttttcaagggcctgtttcccttgcctccataactgttgcaggtattgacggccaggcttctaaacttcttaaaactccccaattctggtgccaacttagacaatactattttaagcactccttttagttatccccacctgcccagttcccttattaggctgagacacttgaactaaattatctgctcccctgactattcctgggctacagctacatctcattgccatctttttgcccagttcaaagcctccttcacatcctccccttgtatctccccaccttaacccacaagtataggacacctctactccctcctcagtgaacgatcatgcaccccttaccatcccattaaaacctaatcaccctcaccctgttcaatgccaatattccatcccacagcacgctttaaaaggattaaagtctgttattacttacctgttacagcatggccttttaaagcctataaactctccttaacaattcccccattttacctgtcctaaaaccagacaagacttacaggttagttcaggatctgcaccttatcaaccaaattgttatgcctatccaccctgtgctgccaaacccatatattctcctatcctcaatacctccctctacaacccattattctgttctggatctcaaacatgctttctttactattcctttgctatttctttactatttctttactatttctttactattctttactattcctttactatttctttactattcctttgcacccttcatcccagcctctcttcgctttcgcttggactgaccctgacagccattaggctcagcaaattacctgggctgtactgccacaagtcttcacagacagcccccattacgtcagtcaagcccaaatttcatcctcatctgttacctatctcagcataattctcataaaaacacatgtgctctctctgccgatcatatccgactgatctctcaaaccccagcaccttctacaaaacaatttgtttccttcctaggcatggttagtgcagtcagaagtcttacacaagagccaggaccacaccctgtagcctttttatccaaaaaacttgaccttactgtttggcctagccctcaagtctgtgtgcagcggccgccgctgccctaatacttttagagacccttaaaatcacgaactatgctcagctcactctctacagttctcataacttgcaaaatctattttcttcctcacatctgacacacatactttctgctcccggctccttcagctgtactcactctttgttgagtctcccacaattgccattgttcctggcctggacttcaatcccacctcccacattattcctgataccacacctgactcccatgactgtatctctctgatccacctgacattcacctcatttccccatatttccttctttcctgttcctcaccctgatcacacttggtttattggtggcagttccaccaggcctaattgccacacaccagcaaaggcaggctatgctatacactagcccgcctcttagaacctctcatttccttcccatcgtggaaatctatcctcaaggaagtaacttctcagtgttccatctgctgttctactactcctcagggattatccaggctccctcccttccctacacatcaagctcgaggatttgcccccacccaggactggcaaattgactttactcctgtgcccccagtcagaaaactaaaatacctcttagtctaggtagacactttcactggataggtagaggcctttcctacagggtctgagaaggccaccacagtcatttcttcccttctgtcagatataattcctcagtttagccttcccacctctacacagtccaatagcagaccggcctttattagtcaaatcagccaagcattttttcaggctcttggtattcagtgaaacctttatataccttacagtcctcagtcttcaggaaaggtagaacagactaatggtcttttaaaaacacacctcaccaagctcagccaccaacttaaaaaggactggacaatactttttaccattttcccttctcagaattcaggcctgtccttggaatgctacagggtacaacccatttgagttcctgtatggatgctcctttttattaagccccagtctcaccagaccaacttggactgtaccccaaaaaatttgtcatccctactattttctgtctagtcatactcctattcaccgttctcaactactcgtgcatgctctgctcttgtgtatactgccggtttacagtgtttctccaagccttcacagctgatatctcctggtgctatccccaaaccgccactcttaactcttaaagtaaataaataatctttgctggcaggactatgctgaatctccttaggcaccctctaattagatgtcctgggtcctcccaattcttaggcctttaatacctgtttttctccttctcttattccatttagtttttcaattcatacaagactgtatccaggccatcaccaataattctatatgacaagtgtttcttctaacagtcctacagtatcaccccttaccacaaaatcttccttcagcctaatctctcccactctaggttcccacgccacccctaatcctgcccaaagcagccctgagaaacatcacccattatctctccataccaccccccaaaaaattttcaccatcccaacactttaccactattttgttttaattttcttattaatataagaagacaggaatgtcagaactctgagcccaagctaagccatcatatcccctgtgacttgcacctacacatccagatggccagttcctgccttaactgatgacattccaccacaaaagtagttaaaatggccggtccttgccttaagtgatgacattaccttgtgaaagtccttttcctggctcaaaaagctcaaaaagcaccttgtggtccccagtcctgcccaccagagaacaaatcccctttgactgtaattttcctttatctacccaaatcctataaaatggccccacccttatctcccttcactgactctcttttcggactcagcctgcctgcacccaggtgattaaaagctttattgctcacacaaagcctgtttggtggtctcttcacatggatgcacatgaaa

SEQ ID NO: 115 - DNA, 5708 bp, Homo sapiens
gtcaggcctctgagcccaagccaagtcatcgcatcccctgtgacttgcacatatacgcccagatggcctgaagtaactgaagaatcacaaaagaagtgaaaatgccctgccccgccttaactgatgacattccaccacaaaagaaatgaaaatggccggtccttgccttaagtgatgacattaccttgtgaaagtccttttcctggctcatcctggctcaaaaagctcccccactcagtaccttgtgactcccacttctgcctgccagagaacaacgcccctttttcctttacctacccaaatcctataaaacggccccacccctatctcccttcactgaccctcttttcggactcagcccacctgcacccaggtgaaataaacagccttgttgctcacacaaagcctgtttggtggtgtcttcacacggacgcacatgaaatttggtgtcgtgattcggatcggaggacctcccttgggagatcaatcccctgtcctccggctctttgctccgtgaaaaagatccatctatgacctcgggtcctcagacccaccagcccaaggaacatctcaccgattttaaatcgggtaagcggcctcttcttactctcttctccaacctctctcactctccctcaaccactttctcctttcaatcttggtgccacccttcaatctctcccttctcttaatttcaattcctttccttttctggtagagacaggagacacgttttatccgtggacccaaaactctggcgccggtcacggacttgggaagacagtcttcccttggtgtttaatcacacggggacaactgcctgattattacccacgtttcagaggtgtctgaccacgcggggacgcctgccttggtccttcacccttagcagcaagtaccgcttttctggggggcaagaaccccccaaccccttctctccatgtctctaccccttctccactgttctgggggacaagaaccccccaaccccttctctctgtgtctctaccccttctctgcttttctgggggcaagaaccccccgatcctttatttccacaccccgctctgtgccccgatcccttatttctgcaccccgacttcttatctctgtgccccaaccccttatttccatgccccgacccctttcctgcttttctggaaggtaagaacccctgaaccccttccctccatgtctttactctcccttttctttaaacttgcctccttcactataggcaaccttccaccctccattcctccttcttctcccttagcctgtgttcttaagaacttaaaacctctcaactctcacctgacctaaaacctaaatgccttattttcttctgcagtgctgcttgaccaaaatacaaactcaacagtggttccaaatagcaagaaaatggcactttcaatttttccatcctacaagatctaaataattcttgtcgtaaaataggcaaatggtctgaggtgcctgacgtccaggcattcttttacacatcagtccctccctagtctctgttcccaaggcaactcgtcccaaatcctccttctttccctcctgcctgtcccctcagtcacaactccaaatgtcgctgagtctttctaatcttccttttctacagacccatctgacctcctcgccaggccgagccaggtcccagttcttcttcagcctctgctccccaccctataatccttttatcacctccattcctcacaccgggtccagcttacagttttgttcctcgactagtcttcccccacctgcccagcaatttcctcttaaaaaggtggctggagctaaaggcacagtcaaggttaacgctcctttttctttatccgacctctcccaaaatcagttagcatttaggctttttttcatcaaatatgaaaaacccagcccagttcatggctcatttggcagcaaccctgagacgctttacagccctagaccctgaaaggtcagaaggccgtcttattctcaatatgcattttattttttttacccaatctgctcccaacatgaaataaagctccaaaaattaaattccggccctcaaaccccacaacaggacttaattaaccccgccttcaaggtgtgcaataataaagtagaggcagccaagtagcaatgtatttctgagttgcaattccttgcctccactgtgagacaaaccccagccacatctccagcacacaagaactccaaacgcctgaacctcctcccccaggagcttgccacaagtgccggaaatctgaccactgggccaaggaatgcccacagcccgggattcctcctaagccatgtcccatctgtgcgggaccccactgaaaattggactgttcaactcacctggcagccacttccagagcccctggaactctggcccaaggctctccgactgactccttcccagatcttctcggcttagcagctgaagactgacgctgcccgatcgcctcggaagcctacaggaccatcacaaatactctgagtaactctcacagtggagggtaagtccatctccttcttagtcaatatggaggctacccactccacattaccttcttttcaagggcctgtttcccttgcctccataactgttgtgggtattgacggccaggcttctaaacctcttaaaactcccaaactctggtgccaacttagacaatactctttgaagcactcctttttagttatccccacctgcccagttcccttgttaggctgagacactttaactaaattatctgcttccctgactattcccggactacagctgcatctcattgccacccttctccccaacccaaagcctcctttgcatcttcttctcatatccccccaccttaacccacaagtatgggacatctctactccttccctggcaactgatcacatgcccattaccatcccattaaagcctaatcactcttaccctgctcaatgttaatatcccatcccacagcacgctttaaaaggattaaagcctgttatcactcacttgctacagcatggccttttaaagcctatatactctccttaccattcccctatttcacctgtcctaaaaccagacaagtcttataggttagttcaggatctgtgccttatcaaccaaattgttttgcctatccacccccgtggtgccaaacccatatactctcctatcctcaatacctccttctacaacccattattcttttctggatctcaaacatgctttctttactattcctttgcacccttcatcccagcctctctttgctttcacttggactgaccctgacacccattaggctcagcaaattacctgggctatactgccgcaaggcttcacagacagcccccattacttcagtcaagcccaaatttcatcctcatctgttacctatctcggcataattctcacaaaaacacacgtgctttccctgctgattgtgtctgactaatctcccaaacctcaatcccttacaaaacaacaactcctttccttcctaggcatggttagtgtggtcagaattcttacacaagagccgggaccacaccctgtagcctttctgtccaaacaacttgaccttactgttttagcctagccctcatgtctgcgtgcagcagctgccactgctctaatacttttagaggccctcaaaatcacaaactatgctcaactcactttctacagttctcataatttccaaaatctattttcttcctcacacctgacacttatactttctgctcccccggctccttcagttgtacccactctttgttgagtcccacaattaccattgttctcggcccggacttcaatccggtctcccacattattccagataccacacctgaccctcatgactgcatctctctgatccacctgacgttcaccccatttccccacatttccttcttccctgtttctcaccctcatcacatttggtttattgatggcagttccaccaggcctaatcaccactcaccagcaaaggcagactatgctatagtactagccactagcccgcctcttagaacctctcatttcctttccatcgtggaaatctatcctcaaggaaataacttctcagtgttccatctgctattctactactcttcatggattattcaggccccctcccttccctacacatcaagctcggggatttgcccccgcctaggactggcaaattggctttactcaatatgccccaagtcagaaaactaaaatacctcttagtctgggtggacactttcactggatgggtagaggcctttcctacaggatctgagaaggccactgcggtcatttcttcccttctgtcagatataattcctcagtttggccttcccacctctatacagtctgataacggaccagcctttattagtcaaatcagccaagcagtttttcaggctcttggtattcagttaaacctttatatcccttacggtcctcagtcttcaggaaaggtagaacggactaatggtctttaaaaaacacacctcaccaagctcagccaccaacttaaaaaggactggacaatacttttaccactttcccttctcagaattcaggcctgtccttggaatgccacagggtacagcccgtttgagctcctgtttggacgctcctttttattaggccccagtctcattccagacaccaaaccaagttggactgtgccccaaaaaacttgtcatccctactatcttctgtctagtcatactcctattcaccgttctcaacgactcatacatgccctgctcttgtttacactgccggtttacactgtttctccaagccatcacagctgatatctcctggtgctatccccaaaccgccactcttaactcttaaagtaaataaataatctttgctggcaggactatgctgaatctccttaggcactctctaattagatgtcctgggtcctcccaattcttagacctttaatacctgtttttctccttctcttattccatttagtttttcaattcatacaaaaccatatccaggccatcaccaataattctaaatgacaaatgtttcttctaacaaccccacaatatcaccccttaccacaagacctcccttcagcttaatccctcccactctaggttcccacgccgcccctaatcccgcttgaagcagccctgagaaacatcacccattctctctccataccacctcacaaaaattttcgccgccccaacacttcaacactgttttgttttatttttcttattaatataagaaggcaggaatgtcaggcctctgagcccaagccaagccatcgcatcccctgtgacttgcacatatacgcccagatggcctgaagtaactgaagaatcacaaaagaagtgaaaatgccctgccccgccttaactgatgacattccaccacaaaagaagtgaaaatggccggttcttgccttaagtgatgacattaccttgtgaaagtccttttcctggctcaaaaagctcccccactcagtaccttgtgacccccacccctgcctgccagagaacaacgcccctttttcctttacctacccaaatcctataaaacggccccacccttatctcccttcactgaccctcttttcggactcagcccacctgcatgcacccaggtgaaataaacagccttgttgctcacacaaagcctgtttggtggtctcttcacatggacgcgcatgaaa

SEQ ID NO: 116 - DNA, 999 bp, Homo sapiens
tgtgcaggtgtacctagcagctccaaagagacagcgaccatcgaggacaagccatgatgacaatggtggttttgtcaaaaagaaaagggggaaatgtggggaagagaaagagagatcagactgttactgtgtctatgtagaaagaagtagacataagagactccattttgttctgtactaagaaaaattattttgcctcgagatgctgttaatctgtaaccctacccttaaccctgtgctggcagaaacacgtgctgtgacgactcaaggtttagtggatttagggctatgcaggatgtgctttgttaaacaaatgcttgaaggcagcatgcttgttaaaagtcatcaccactccctaatctcaagtacccggggacacaaaacactgtggaaggctgcagggacctctgcctaggaaagccaggtattgtccaaggtttctccccatgtggtaatctgaaatatggcctcgtgggaagggaaagacctgaccgttccccagcccgacacccgtaaagggtctgtgctgaggaggattagtaaaagaggaaggcctctttgcagttgagataagaggaaggcatctgtctcctgctcgtccctgggcaatagaatgtctgggtgtaaaacccgattgtatattccatctactggagataggagaaaaccgccttagggctggaggtgagacatgctggcggcaataggcaatagtgctctttaaagcattgagatgtttatgtatgtgcacattaaaagcacagcacctttttctttaccttgtttatgatgtagagatgtttgttcacgttttcctgctgaccctctccccactattaccctgttgtcctgccactctccattgtctccctgttgtccccctctccgatatggtagagatactaatgaataaatactgagggaactcagagaccggtgccggcgtgggtcctccatatgctgaacgccggttccctgggcccacttttctttctctat

SEQ ID NO: 117 - DNA, 5727 bp, Homo sapiens
gtcaggcctctgagcccaagctaagccatcattcccctgtgacctacacgtacacatccagatggccggttcctgccttaactgaccacagtccaccacaaaagaagtgaaaatggcctgttcctgccttaactgatgacattgtcttgtgaaattccttctggctcattctggctcaaaagctcccccactgagtaccttgtgacccccactcctgcccaccagagaacaaccccctttgactgtatttttcctttatctacccaaatcctataaaatggccccacttttatctcccttcgctgactctcttttcggactcagcccgcctgcacccaggtgattaaaagctttattgctcatacaaagcttatttggtggtctcttcacacagacgcgcatgaaatttggtgccgtgactcggatggggggacctcccttgggagatcaatcccctgtcctcctgctttttgctccatgagaaaggtccacctatgacctcaagtcctcagaccaaccagctcaagaaacatctcaccaatttcaaatctggtaagcggcctctttttactctcttctacaacctccctcattatccctcaacctctttctcctttcaatcttggcgccacacttcaatctctcccttctcttaatttcaattcctttcattttctggtagagacaaaggagacaagttttatccatggacccaaaactccggcgccggtcacggactgggaaggcaggcttcccttggtgtttaatcattgcaaggacacctctctgattattcacccaggtttcagtggtgtcagaccatgcagggacgcctgccttggtccttcacccttagcggcaagtcctgcttttctgtgggaggggcaagtaccccaaccccttctctccatgtctctaccccttctctgccattctggggggcaagaaaccccaaccccttctccttcacccttagcagcaagtcccacttttctaggggaggagcaagtaccccaaccccttatatctctgcaccccgatcccttatttctgcaccccaacctcttatatctctgcgcaccgatcccttatttctgtgccccaacctcttatatctctgtgccccaatcccttatttccgcactccgacctcgtatctctgtgccccgacccctttcccacttttctggagggtaagaacccccaaaccccttccctccatgtctctactctcttttctctgggcttgcctccttcactatggacaaccttccacccatagtggaaggagattcctccttcttctcccttatcctgtgttcttaagaacttaaaacctcttcaattctcacctgacctaaaatctaagcatcttattttcttctgcaatgccacttgaccccaatacaaactcgacagtagttccaaatagccagaaaacggcactttcaatttttccatcctgcaagatctaaataattcttgtagtaaaacgggcaaacggtctgaggtgcctgacgtccaggcattcttttacacgtcggtcccttcctagtctctgtgcccagtgcaagtcatcccaaatcttccttctttccctcccgcctgtcccctcagttccaaccccaagcgtcactgagtctttctaatcttccttttctacagacctagctgacctctcccctcctcaccaggcagagctaggtcccaattcttcctcagcctctgctcctccaccctataatccttttatcacctcccctcctcacacccggtcgggcttacagttttgttctgtgactagccctcccccacctgcccagcaatttactcttataaaaggtggctggagctaaaggcgtagtcaactttaatgctcctttttctttatcccaaatcagatagcgtttaggctctttttcatcaaatataaaaatccagcacagttcatggctcgtttggcagcaactctgagacgctttacagccctagaccctagaaggtcaaaaggccgtcttattgtcaatatacattttattatccaatccactcctgacgttaaataaaactccaaaattaaattccggccctcaaaccccacaacaggacttaattaacctcaccttcaaggtgtacaataatagagtagaggcagccaagtagcaatgtatttctgagttgcaattacttgcctccactgtgagacaaaccccagccacatctccagcacacaaaaacttccaaacgcctgaaccgcagcagccaggcgttcttccagaacctcctcccccaggagcttgctacaagtgccagaaatttggccaacaggccaaggaatgcccgcagcccgggattcctcctaagccgtgtcccatctgtgcgggaccccactggaaatcagactgttcaactcaattggcaaccactcccagagcccctggaattctggcccaaggctctctggctgactccttcccagatcttcttggcttagcagctgaagactgacactgcccaatcacctcagaagcctacaggaccatcacagatgctctaggtaactctcacagcggagggtaagtctgtccccttcttaatcaatacggagcctacccactccacattaccttcttctcaagggcctgtttcccttgcctccataactgttgtgggtattgacggccaggcttctaaacctcttaaaactccccagctctggtgccaacttagacaatactcttttaagcactccttttagttatccccacctgcccagttcccttattaggccgagacactttaactaaattatctgcttccctgactattcctggactacagctacatctcattgccgcccttcttcccaatccaaagcctcctttgcgtcctcctcttgtattcccccaccttaacccacaagtataagatacctctactccctccttggagactgatcatgcaccccttaccatctcattaaaacctaatcacccttaccacccacaacaccaatatcccatcccacagcatgctttaaaaggattaaagcctgttatcacttgcctgctacagcatgggcttctaaaacctataaactctccttacaattcccccattttacctgtccaaaaactggacaagtcttacagattagttgaggatctgcgccttatcaaccaaattgttttgcctatccatcctgtggtgccaaacccatacactcttttgtgctcaataccttcctccacaactcactattctgttctggatcttagagatgcttttttcactattcccctgcaccctgcgtcccagccttgctttgctttcacctggactgaccctgacacccattaggctcagcaaattacctaggctgtactgccacaaggcttcacagacagcccccattatctcagtcaagcccaaatttcatcctcatctgttacctatctccacataattcacataaaaacacacgtgctctccctgctgattgtgtccgattaatctcccaaacctcaatcccttaaaaaacaactcctttcctgcctaggcatggttagtgcggtcagaattcttacacaagagccaggacctcaccctgtagcctttctgtgcaaacaacttgaccttactgttttagcctagccctcatgtctccatgcagcagctgctgccaccctaatacttttagaggccctcaaaatcacaaactatgctcaacttactctctatatttctcataacttccaaaatctattttcttcctcatacctgacgcatatactttcggctccctggctccttcagctgtactcactctttgttaagtcccacaattaccattgttcctggcccggacttcaatctggcctcccacattatttctgataccacacctgacccccatgactgtatctctctgatccacctgacattcaccacatttccccatatttccttctttcctgttcctcaccctgatcacacttgatttattgatggcagttccaccaggcctcatcaccacacaccagcaaaggcaggctatgctatagtacaagccactagcccgcctcttagaacctctcattttctttccatcgtggaaatctatcctcaaggaaataacttctcagtgttcatctgctattctactactccttagggattattcaggccccctcccttccctacacatcaagctcaaggatttgcccccacccaggactggcaaattagctttactcaacatgtcccgagtcagataactaaaatacctcttagtctagataggcactttcactggataggtacaggcctttcctacagggtctcagaaggccaccgtagtcatttcttcccttctgtcagacataattcctcagtttagccttcccacctctatatagtctgataacagaccaacctttattagtcaaatcagccaagcagtttttcaggctcttagtattcagtgaaacctttatatcccttacggtcctccatcttcaggaaaagtagaacggactaaaggtcttttaaaaacacacctcaccaagctcagccaccaacttaaaaaggactggacaatacttttgccactttcccttctcagaagtcagacctgtcctcagaatgctacagggtacagcccatttgagctcctgtataaatgctcctttttattaggccccagtctcattccagacatcagaccaacttagactgtgcccccaaaaaacttgtcatccctactgtcttctgtctagtcatactcctattcaccgttctcatctactcatacatgccctgctcttgtttacactgccagtttacactgtttctccaagccatcacagctgatatctcctcgtgctatccccaaaccaccactcttaactcttaaagtaaataaataatctttactggcaaggctatgctgaaccaccttaggcactctctaattagatgtcgtaggtcctcccaattctgagtcctttaatacctgtttttctccttctcttattctgtttagtttttcaattcatacaaaactgtatccaggccatcaccaatcattctaaatgacgaatgtttcttctaacaaccccacaatatcaccccttaccacaaaatcttccttcagcttaatctcttccactctaggttcccacgccgcccctaatcccgctcgaagcagccctgagaaacatcgcccattctctctccataccgtcccccaaaattttcaccgtcccaacactttaccactatttcgttttatttttcttattaatataagaagacaggaatgtgaggcctctgagcacaagctaagccatcttatcccctgtgacctgcacgtacacatccagatggccggttcctgccttaactgatgacattccaccacaaaagaagtgaaaatggcctgttcctgccttaaccgatgacattgtcttgtgaaattccttctcctggctcatcctggctcaaaagctccctcactccttgtgacccccactcctgcccacaagagaacaaccccctttgactgtaattttcctttatctacccaaatcctataaaatggccccacccttatctcccttccctgactctcttttcagactcagcccgcttgcacccagatgattaaaagctttattgctcacacaaagcctgtttggtggtctcttcacaaggacgcgaatgaaa

SEQ ID NO: 118 - DNA, 5283 bp, Homo sapiens
tgactctcttttcggactcagcccacctgcacccaggtgaaataaacagccacgttgctcacacaaagcctgtttggtggtctcttcacacggacgcgtatgaaatttggtgccgtgactcggattgggggacctcccttgggagatcaatcccctgtcctcctgctctttgctccgtgagaaagatccacctatgacctcaggtcctcagaccgcccagcccaagaaacatcacaccaatttcaaatccggtaagcggcctctttttactctcttctccaacttccctcactatccctcaacctctttctcctttcaatcttggcgctacacttcaatctctcccttctcttaatttcaattcctttcattttctggtagagacaaaagagacacgttttatccgtggacccaaaactccggcgccggtcacggactgggaaggcagccttcccttggtgtttaatcaatgcagggacgcctctctgattatacacccatgtatcaagggtgtcagaccacgcagggacgcctgccttggtccttcacccttagcggcaagtcccgcttttctggggaaggggcaagtaccccaaccccttctctccttgtctctaccccttctctgctttcctggggcaggggcaagtacccctcaaccccttctccttcacccttagcggcaagtcccgctttcctggggcaggggcaagtacccctcaaccccttctccttcacgcttagcggcaagttccgctttcctggggcaggggcaagtacccctcaaccccttctccttcacccttagcggcaagtcctgcttttctagggggcaagaacccccaaaccccttccctccgtgtctctacgctctcttttctctgggcttgcctccttcactatgggcaagcttccaccttccattcctccttcttctcccttagcctgtattcttaagaacttaaaacctcttcaactctcacctgacctaaaatctaagtgtcttattttcttctgcaatgtcgcttgaccccaatacaaactcgacagtagttccaaatagccggaaaacggcactttcaatttttccgtcctacaagatctaaataattcctgtcgtaaaatgggcaaatggtctgaggtgcctgacatccaggcattcttttacacatcagtccattcctagtctctgtgcccaatgcaactcgtcccaaatctcctgcctgtcccctcagtcccaacgccaagcgtcgctgagtctttctaatcttccttttctacagacccatctgacctctcccctcctagccaggccaagctaggtcccaattcttcctcagcctccactcctccaccctataatctttttatcgcctcccctcctcacacctggtctggcttacagtttcgttctgtgactagccctcccccacctgcccagcaatttattcttaaaaaggtggctggagctaaaggcatagtcaaggttaatgctcctttttctttatcccaaatcagatagtgtttaggctttttcatcaaatataaaaacccagcccagttcatggctcgttcggcagcaaccctgagacgctttacagccctagaccctaaaaggtcaaaaggctatcttattctcaatatacattgtattacccaatctgctcccgacattaaataaaactccaaaaattaaattctggccctcaaaccccacaacaggatttaattaacctcgccttcaaggtgtacaataatagaaaaaagttgcaattcctggcctccactgtgagacaaaccccagccacatctccagcacacaagaacttccaaatgcctgaactgcagcggacaggcgttcctccagaacctcctcccccaggagcttgctacaagtgccagaaatctgaccactaggccaaggaatgcctgcagcccaggattcctcctaagacatgtcccatctgtgcgggaccccactggaaattggactgttcaactcacctggcagccactcccagagcccctggaactctggcccaaggctctctgactgactcctcggcttagcggctgaagactgatgctgcccgatcgcctcggaagccccgtagaccatcacggaccccgagcttcgggtaactctcacagtggaaggtaagtccgtccccttcttaatcaatatggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaaattatctgcttccctgactattcctggactacagctacatctcattgctgcccttcttcccaatccaaagcctcctttgtgtcctcctcttatatccccccaccttaacccacaagtataagatacctctactccctccttggcgaccgatcatgcaccccttcccatctcattaaaacctaatcacccttaccccgctcaatgtcaagatcccatcccaaagcatgctttaaaaggattaaagcctgttatcacttgcctgctacagcatgaccttttaaagcctataaactctccttaccattcccccattttacctgtcctaaaaccagacaaggcttacaagttagttcagaatctgcaccttatcaaccaaattgttttgcctatccaccccgtggtgccaaacccatatattctcctatcctcaatacctccctctactacccattattctgttctagatctcaaacgtgctttctttactattcctttgcacccttcatcccagtctctctttgctttcactttggccctgactcagcaaattacctaggctgtactgccgcaaggcttcacagacagcccccattacttcagtcaagcccaaatttcatcctcatctgttacctatctcggcataattctcataaaaacacacgtgctttccctgctgatcatgtccgattaatctctcaaacctcaatcccttacaaaacaacaactcctttccttcctaggcatggttagtgcggtcagaattcttacacaagagccaggactgcaccctgtagcctttctgtccaaacaacttgaccttactgttttagcctagccctcatgtctgcgtgcagcggctgccgctgctttaatacttttagaggccctcaaaatcacaaactatgctcaactcactctctacatttctcataacttccaaaatctattttcttcctcatacctgacgcatatactttctgctccccggctccttcagctgtacttactctttaagtcccacaattaccattgtttctggcccggacttcaatccggcctcccacattattcctgataccacacctgacacccatgactgtatctctctgatccacctgatattcaccccatttccccatatttccttctttcctgttcctcaccctgatcacgcttgatttattgatggcagttccaccaggcctaatcgccgcataccagcaaaggcaggctatgctatagtacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgccccacccaggactggcaaattagttttactcaacatgcctgagtaaggaaactaaaatacctcttagtccaaatagacactttcactgaataagtaaaggcctttcctacagggtctgagaaggccaccgcagtcatttctttccttctgtcaaacataattcctcagtttagccttcccacctctatacagtctgatgacggaccagcctttattagtcaaatcagccaagcagtttttcaggcttttagtaggtttcagtgaaacctttatatcccttacggtcctccgtcttcaagaaaagtagaacggactaaaggtcttttaaaaacacagctcaccaagctcagccaccaacttaaaagggactggacaatacttttaccacttttgcttctcagaattcaggcctgtcctcagaatgctacaaggtacagcccatttaagctcctgtatagacgctcctttttattaggccccagtctcatttgacaccagaccaacttagactgtgcccccaaaaaacttgtcatccctactatcttttgtctagtcatactcctattcaccgttctcaactactcatgcatgccgtgctcttgtttacactgccggtttacactttctcctagccatcacagctgatatctcctggtgctatccccaaactgccactctaaactcttgaagtaaataaataatctttgctggcaggactatgctgcatctccttaggcactctctcatcagatgtcctaggtcctcccaattcttagaccttttatacctgtttttctccttctcttattccattttgtttctcaattcatccaaaaccgtatccaggccatcaccaatcattctatacgacaaatgtttcttcttacatccccacaatatcaccccttaccacaagatctcccttcagcttaatctctcccactctaggttcccacgccacccctaatcccgcttgaagcagccctgagaaacatcacccattctctctccataccaccccccaaaaattttcaccaccccaacacttcaacactattttgttttgtcttattaatataagaaggcaggaatgtcaggcctctgagcccaggccaggccatcgcatcccctgtgacttgcacgtatacatccagatggcctaaagtaactgaagatccacaaaagaagtaaaaacagccttaactgatgacactccaccattgtgatttgttcctgccgcaccctaactgatcaatgtactttgtaatctcccccacccttaagaagggactttgtaattctccccacccttgagaatgtactttgtgagatccacccctgcccaccagagaacaaccccctttgaccgtaattttccattaccttcccaaatcctataaaacggccccacccgtatctcccttcactgactctcttttcggactcagcccacctgcacccaggtggaataaacagccatgttgcacacacacac

SEQ ID NO: 119 - DNA, 486 bp, Homo sapiens
agaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttctttaatccggtgcctgaggagttttgtctgtggctcgtcctgctaca

SEQ ID NO: 120 - DNA, 7483 bp, Homo sapiens
gttaggcctctgagcccaagctaaggcatcgcatcccctgtgacctgcacatatacacccagatggcctgaagtaactgaagcatcacaaaagaagtgaaaatggcctgttcctgccttaactgatgacattccaccacagaagaagtgaaaatggctggtccttgccttaagtgatgacattaccttgtgaaattccttttcctggttcatcctggctcaaaaaagctcccccactgagcaccttgtgatccccactcctgcccaccagagaacaaccccactttgactgtaattttcctttacctacccaaatcttataaaatggccccacccctatctcccttcactgactctcttttcagactcagcccgcctgcacccaggtgattaaaaagctttattcctcacacaaagcctgtttggtggtctcttcacacgaacgcgagtaaaatttggtgccgtgactcggattgggggacctcccctgggagatcaatcccctgtcctcctgctctttgctccgtgagaaagatccacctacgacctcaggtcctcagaccaacctgcccaaggaacatctcaccaattttaaatctggtaagcagcctctttttactctcttctccaacctctctcactatccctcaacctctttctcctttcagtcttggcaccacacttcaatctctcccttctcttaatttcagttcctttccttttctggtagagacaaaggagacgtgttttatccgcggacccaaaactccggcgccggtcatggacttgggaaggcagccttaccttggtgtttaatcattgcagggatgcctgcctgattattcacccacgtttcagaggtgtctgaccatgcagggacgcctgccttggtccttcacccttagtggcaactaccgcttttctggagggcaagaacccccgaccccttctttccatgtctctactctctcttttctctgggcttgcctccttcactatgggcagccttccacctccattcctccttcttctcccttagcctgtgttctcaagaacttaaaacctcttcaactcacagctgacctaaaacctaaacaccttattttcttctataatgccgcttcaccccagtacaaacttgacagtggttccaaatagccagaaaactgcacttctgatttttccatcctacaagatctagataattgttgtcataaaataggcaaacggtctgaggtgcctgacatccaggcattcttttacacattgttccctccttactctctgttcccaatgcgacttgtcccagatcctccttctttccctcccgcctgtcctctcagtcccaaccccaagtgtcgctgagtctttctaatcttccttttctatatacccatctgacctctcccctcctccccaggctgctcctcgccaggtcccaattcttcctcagcctctgctcccccaccctataatccttttatcacctcccctcctcacacccagtctggcttacaatttcgttccgtgactagccctcccccacctgcccagcaatttcctcttaaaaaggtggctggagctaaaggcatagtcaaggttaatgctcctttttctttatccaacctctcccaaatcagttagtgtttaggctctttcaacaaatatgaaaaacccagcccagttcattgctcgttcggcagcaaccctgagacgctttacagccctagaccctgaaaggtcagaaggccatcttattctcaatatgcattttattttattacccaatctgctcccaacattaaataaagctccaaaaattaaattccagccctcaaaccccacaacaggacttaattaacctcaccttcaaggtgtacaataataaagtagaggcagccaagtagcaatgtatttctgagttgcaattccttgcctccactgtgagacaaaccccagccatatctccagcacacaagaactccaaatgcctgaaccatagctgccaggggttcctccagaacctcctcccccaggagcttgctacaagtgctggaaatctggccactgggccaaggaatgcccacagaccaggattcctcctaagccatgtcccatctgtgcaggaccccattgaaaatcggactgttcaactcacctggcagccactcccggggtccctggaattctggcccaaggctctctgactccttcccagattttcttggcttagcggctgaagactgacactgcccgatcgccttggaagcccctagaccatcacgggcgccaagcttcaggtaactctcacagtggagggtaagtccatccatcctcttcttaatcaatacagaggctacccactccacattaccttcttttcaaaggcctgtttcccttgcctccataactgttgtgggtattgacggccgggcttctgaacttcttaaaactccccaactctggtgccaacttagacaataatctttcagcactccttttagttatccccacctgcccagttcccttattaggctgagatattttaactaaattatctgcttccctgactattcttgggctacagccacatctcactgccgcccttcttcccaacccaaagcctcccttgcgtcttcctctcgtatccccccctccttaacccacaagtataggacatctctactccctccctggcaaccaatcacatgcccattaccatcccattaaaacctaatcacccttaccccgctcaatgccaatatcccatcctacagcatgctttaaaaggattaaagcctgttatcactcgcctgctacagcatagccttttaaagcctgtaaactccccttgcagttaccccatttcacctgtcctaaaaccagacaaagcttacaggttagttcagaatctgcgtcttatcaaccaaattgttttgcctatccaccctgtggtgccaaacccatatattctcctatcctcaatacctccctccataatccattattctgttctggatctcaaacatgctttctttactattcctttgcacccttcattccagcctctctttgctttcacttggactgacccgacagccatcaggctcagcaaattacctaggctgtactgctgcaaagcttcacagacagcccccattacttcagtcaagcccaaatttcttcctcatctgttacctatctcagcataattatcataaaaacacatgtgctctctctgctgatcatgtccggctaatctcccaaaccccaatcccttctacaaaacaacaactcctttccttcctaggcatggttagtgtggtcagaattcttacacaacagccagaaccgcgccctatagctttctgtccaaacaacttgaccttactatttcagcctagccctcatgtctgtgtgcagccgctgctgctgccttaatacttttagaggccctcaaaatcacaaactatgctcaactcactctctacagttctcataacttccaaaatctattttcttcctcatacctggtgcatatactttctgcttcccagctccttcagctgtactcactctttgttgagtctcccacagttaccattgttcctggcccggacttcaatccggcctcccacacctgaccctcatgactgtatctctctgatccacctgacattcactccatttccccatatttccttcttccctgttcctcaccctgatcatatttggtttattgatggcagttccaccaggcctaatcaccacacaccagcaaaggcaggctatgctatagtacaagccactacccgcctcttagaacctctcatttcctttccactgtggaaatctatcctcaaagaaatcacttctcaatgatcgatctgctattctactacccctcagggattgttcaggccccgtccctttcctacacatcaatctcagggatttgcccccacccaggactggcaaattgactatactcacatgccccaagtcagaaaactaaaatacctcttagtctgggttgacactttcactggatgggtagaggcctttcccacagggtctgagaaagccaccgcagtcatttcttcccttctgtcagacagacataattcctcggtttggccttcccacctctatacagtctgataatggatcggcctttactagtcaaatcacccaagcagtttctcaggctcttggtattcagtggaaccttcatatcccttaccgtcctccatcttcaggaaaggtagaacagactaatgttgttttaaagacacacctcaccaagctcagcctccaacttcaaaaggattaggcagtacttttacctcttgcccttcttagaattagagcctgtcctcgagatgctacagggtacggtccatttgaacatttatatggatgcactttcttgctcagccccaacctcatcccagacaccagccctctaggcaactatcttccagtcctccaggaggctagacaggaaattcaccaggctgctaatctcttgcctactccagattcccagcaatatgaagacaccctagctggacgatcagttcttgttaagaatctgacccctcaaactctactacctcgaaggaccggaccctacttagtcatctgtagtaccccaactgccgtctgcctgcaggatcctccccactgggtttaccattccagaataaagctgtgtccatcggacagccagcctaatccctcctcttcctcctggaagtcgcaagcactctcccctacttcccttaaactcactcgtatttctgaagaacagtagtaacccttatgagcctaacacatcccttcattctattaggtctgttcatccttaccctactttttgcaacagggctttacaaagtcacccccactactaggaccgagccccaaaaactagtcatccctactatcttctgtctagtcatactcctattctccattcttaactacttataaatgccctactcttgtttacactgctggtttacactgtttcttcaagccatcacagctgatatttcttagtgctatccccaaaacaccactcttaactctctcttagagcagatagatgatctttgctggcaggggactctccaatactttcaccctgatgaagttctattctttacttttatactgactcttttcgtcattcccattcttatgccaccctctacctctccccagctctctccaccacactatcaaccttacccattctctcctagctgtttctaatccctcctcatcgaacaactgctagctttgcatttccctttcttccagcgtctacacagctgtccccgccttacatgcagactgggcaacatctcctgtctccttacacctccgaacttcctttaacagccctcacctttaccctcctgaagaactcatttactttctagacaggtgcagcaagacctccccagacatttcacatcagcaagctgctgacctcctccacacttacttaaaaaacctttctccttatatcaactctactccccctatatttggacctctcacaacacaaactactattcctatggccgctcctttatgtgtctctcggcaaagacacactggaattcccctaggtaacctttcaccttcttgatgttcctttactcttcatctccagagcccaactacacacatcactaaaactgttggagccttccagctccatattacagacaagccctctatcaatactggcaaacttaaaaacattagcagtaattattgcttaggaagacacttaccctgtatttcactccatccttagctaccttccgcttgctcgtcagactctcctcccaggccctcttcttgtttacttatacccagccccaaaaataacagtgaaaggttgctcgtagatactcaacattttctcatacaccatgaaaatcaaaccttcccctctatgcagttaccccatcagtccccattacaacctctgacggctgccgccctagctggatccctaggagtctgggtacaagacatccctttcagcactccttctcatctttttactttgcaactccagttttgcctcgcacaaggtctcttcttcctctgtggatcctctacctacatgtgtctacctgttgattggacaggcacatgcacactagttttccttgctcccaaaattcaatttgcaaatgggaccgaagagctccctgttcccctcatgacactgacatgacaaaaaagagttattccattaattcccttgcttgtcggtttaggactttctgcctccactattgctctcagtactggaatagcaggcatttcaacctctgtcatgaccttctgtagcctctctaatgacttctctgctagcatcacagacatatcgcaaactttatcagtccctacaggcccaagttgactctttagctacagttgtcctccaaaaccgctgaggccttgatttactcactgctgaaaaaggaggactctgtatattcttaaatgaagagtgttgtttttacctaaatcaatccagcctggtgtatgacaacataaaaaaactcaaggatagagcccaaaaacttgccaaccaagcaagtaattacactgaacctcattgggcactctgtaattggatgtcctgggtcctcccaattcttagtcctttaatacctatttttctccttttattcagaccttgtatcttctgtttagtttctcaattcatccaaaaccgtatccggggcatcaccaatcattctatacgacaaatgtttcttctaacaaccccacaatatcaccccttaccacaaaatcttccttcagcttaatctctcccactctaggttcccacggcgcccctaatcctgctcgaagcagccctgagaaacaccgcccattatctctccatgccaccccctcaaaaaaaatttctttctgctgccccaacacttcaatactattttatgttatttttcttattaatataagaaggcaggaatgtcaggcctctgagcccaagctaagccatcgcatcccctgtgacctgcatgtgtatgcccagatggcgtgaagtaactgaagaatcacaaaagaagtgaaaatggcctgttcctgccttaactgacattccaccacaaaagaaatgaaaatggctggtccttgccttaagtgatgacattaccttgtgaaattccttttcctggctcatcctggctcaaaaaagctcccccactgagtaccttgtgaccccccactcctgcccaccagagaacaaccccactttgactgtaattttcctttacctacccaaatcttataaaatggccccaccccatctcccttcactgactctcttttcggactcagcctgcatgcagccaggtgattaaaaagctttattgctcacacaaagcctatttggtggtctcttcatgcgaacgcgagtgaaa

SEQ ID NO: 121 - DNA, 5861 bp, Homo sapiens
gtcaggcctctgagcccaagccaagccatcgcatcccctgtgacttgcacgtatatgcccagatggcctgaagtaactgaagaatcacaaaagaagtgaatatgccctgccccaccttaactgatgacattccaccacaaaagaagtgtaaatggccggtccttgccttaagtgatgatattaccttgtgaaagtccttttcctggctcatcctggctcaaaaagcacccccactgagcaccttgcgaccccccactcctgcctgccagaaaacaacccccctttgactgtaattttcctttacctacccaaatcctataaaatggccccacccctatctccctttgctgactctcttttcggactcagcccacctgcacccaggtgattaaaagctttattgctcacacaaagcctgtttggtggtctcttcacatggacgtgcatgaaatttggtgccgtgactcagatcgggggacctcccttgggagatcaatcccctgtcctcctgttgtttgctccatgagaaagatccacctacgacctcaggtcctcagactgaccagcccaaggaacatctcaccaattttaaatcaggtaagcggcctcttcttactctcttctccaacctctctcactgtccctcaaccattttctcctttccactcttcaatctctcccttctcttaatttcaattcccttcattttctgggagagacaaaggagacacgttttatccgtggacccaaaactccagcaccggtcacggactaggaaggcagacttcccttggtgtttaatcattgcaaggacacctctctgattattcatccacatttcaaaggtgtcagaccacgcagggatgcctgccgtggtccttcacccttagcgacaagtcccgcttttctgggaaaggggcaagtaccccaaccccttctctccttgtctctaccccttctctgcttttctgggggaggggcaagtacccctcaaccccttctccttcaaccttagtggcaagtcccgcttttctgggggaggggcaagtacccctcaaccccttctccttcactcttagtggcaagtcccacttttctagaggagggggcaagtaccccaacctcatatctctgtgctccaatcccttatttccatgccgcgaccccttatttccgtgccccgaccccttatttccatgccccgaccccttatttccatgccccatcccttatttctatgcctcaacctcttatctctgtgccccaaccccttttcccacttttctggaaggtaagaacccccaaaccccttccctccatttctctactctctcttttctctaggcttgcttccttcactataggcaactttccaccctccattcctccttctactcccttggcctgtgttctcaaaaacttaaaacctcttcaactcacatctgacctaaaacctaaatgccttattttcttctgcaatgccgcttgaccccagtacaaacttgacagtagttccaaatagccagaaaatggcactttgaatttttccatcctgcaagatctaaataattcttgtcataaaataggtaaacggtctgaggtgcctgacgtccaggcattcttttacacattagtcacttcctagtctctgtgcccagtgcaactcgtcccaaatcttccttctttccctcccacctgtcccctcagtaccaaccccaagcattgctgagtctttctaatcttccttttctgcagacccatctgacctctcccttcctccccaggctgctccttgccaggctgagctaggtcccaattcttcctcagcctctgctcctccatgctataatctttttatcacctcccctcctcacactgggtcctgcttacagtttcgttacgtgactagccctccccatcctgcccagcaatttactcttaaaaaagtggctggagctaaaggcatagtcaaggttaatgctcctttttctttatcccaaatcagatagggtttaggctctttttcatcaaatataaaaacccagcccagttcatgacttgtttggcaacaaccctgagacactttacagccctagaccctaaaacgtcaaaaggccgtcttattctcaaaatacattttattacccaatctgctcccgacattaaataaaactccaaaaattaaattccggccctcaaaccccacaacaggatttaattaacctcgccttcaaggtgtataataatagaaaatagttgcaattccttgcctccactgtgagacaaaccccagccacatctccagcacacaagaacttccaaacgcctgaaccgcagcggccacgcgttcctccagaacctcctcccacaggagcttgctacatgtgccgggaatctggccactgggccaaggaatgcctgcagcccaggattcctcctaagccgcgtcccatctgtgtgggaccccactgaaaatcggactgttcaactcacctggcagccactcccagagcccctggaactctggcccaagcctctctgactgactccttcccagatcttctcggcttagcggctgaagactgacactgccggatcacctcggaagccccctagaacgtcactgacgccgagcttcaggtaactctcacagtggaaggtaagcccgtccccttcttaatcaatacggaggctacccactccacattaccctcttttcaagggcctgtttcccttgcctccataactgttgtgggtattgatggccaagcttctaaacctcttaaaactccccaactctggtgccaacttagacaatactcttttaagcactcctttgtagttatccccacctgcccagttccctgattaggctgagacactttaactaaattatctgcttccctgactattcctggactacagctgtatctcattgccgcccttcttcccaatccaaagcctcctttgcgtcctcctcttgtattcccccaccttaacccacaagtataagatacctctactccctccttggggactgatcatgcaccccttaccatctcattaaaacctaatcacccttaccccactcaacgccaatatcccatcccgcagcatgctttaaaaagattaaagcctgttatcactcgcctgctacagcatagtcttttaaagcctataaactctccttacaattcccccattttacctgtcctaaaaccagacaagccttacaagttagttcaggacctgcacattatcaatcaaattgttttgcctatccaccctgtggtgcccaacccgtacactcttttgtcctgaataccttcctccacaactcactattccctgcttgatcttaaagacgcttttttcactattcccctgcacccctcgtcccagcctctctttgctttcatttggactgaccttgacaccatcaagctcagcaaactacctaggctgtactgccgcaaagcttcacagacagcccccattacttcaatcaagcccaaatttcttcctcatctgttacctatctcggcataattctcataaaaacacacgtgctctccctgccaatcgtgtctgactgatctctcaaaccccagcacctcctacaaaacaacaactcctttccttcctaggcatggttagcgcagtcagaattcttacacaagagccaggaccacaccctgtagcctttctgtccaaacaacttgaccttactgttttagcctagccctcatgtctgcatgcagtggctgccgctgctttaatacttttagaggccctcaaaatcacaaactatgctcaactcactctctacagttctcataacttccaaaatctattttcttcctcatacctgacgcatatactttctgcttcccggctccttcagctgtacactctttgttgagtctcccacaattactgttgttcctggcccagacttcaatccggcctcccacattattcctgataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcagtttatactatagtacaagccactagcctgcctcttagaacatctcatttcctttccatcatgggaatctatcctcaaggaaataacttctcagtgttccatctgctattctactactcctcagggattattcaggcctcctcccttccctacacatcaagctcaaggatttgccccacccaggactggcaaattagctttactcaacatgccctgagaccgataactaaaaaaacctcttagtctaggtagatactttcactggataggtagaggcctttcctacaggtctgagaaggcccccgcagtcatttcttccattctgtcagacataattcctcagtttagccttcccacctcaatacagtctgataacagacgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaagctcctgtatagatgctcctttttattaggccccagtctcattccagacaccagaccaacttagactgtgccccaaaaaaacttgtcatccctactatcttctgtctagtcatactcctattcaccattctcaacgactcatacatgccttgctctggtttacactgccggtttacactgtttttccaagccatcacagctgatatctcctggtgctatccccaaactgtcacttttaactcttgaagtaaataaataatctttgctggcaggactatgccgaatctccttaagcactctctaatcagatatcctgagtcgtcccaattctcagaccttttatacctgtttttctccttctgttattccatttagtttctcaattcatccaaaaccgtatctaggccatcaccaatcactctatatgacaaatgtttcttctaacatccccacaatatcaccccttaccacaagacctcccttcagcttaatctctcccactctaggttcccacgccgcccctaatcccgcttgaagcagccctgagaaacatcgtccattctctctccatatcaccccccaaaaattttcgctgccccaacacttcaacacttttttgttttatttttcttattaatataagaaggcaggaatgtcaggcctctgagcccgagccaagccatcacgtcccctgtgacttgcacatatacgcccaggtggcctaaagtaactgaagaatcacaaaagaagtgaaaatgccctgccccaccttaactgatgacattccaccacaaaagaagtgtaaatggctggtccttgccttaagtgatgacattaccttgtgaaagtccttttcctggctcatcctggttcaaaaagcacccccactgagcaccttgcaacccccactcctgcctgccagagaacaacccccctttgactgtaattttcctttacctacccaaatcctataaaacggccccacccctatctccctttgctgactctcttttcggactcagcccacctgcacccaggtgattaaaagctttattgctcacacaaagcctgtttggtggtctcttcacagggacacgcatgaaa

SEQ ID NO: 122 - DNA, 6486 bp, Homo sapiens
taagccatcatatcccctgtgacctgcatggacacatccagatggccggttcctgccttaactgatgacattccaccacaaaagaagtgaaaatggcctgttcctgccttaactgatgacattaccttgtgaaattccttctcctggctcatcctggctcaaaatctccccccagtgagcaccttgtgacccccacccctgcccgccagagaacaaccccccttttttcctttacctacccgaatgttataaaacagctccacccctatcttccttcgctgactctcttttcggattcagcctgcctgcacccaggtgattaaaaagctctatttctcacacaaagactgtttggtggtctcttcacatggacgcgaatgaaattttggtgccgtgactcagatcgggggacctcgcttgggagatcaatcccctgtcctcctgctctttgctccgtgagaaagatccacctacaacctcgggtcctcagaccaaccagcccaaggaacatttcaccaattttaaatcaggtaagcggcctctctttactctcttctccaacctctctcattatccctcaacctctctcctttcaatcttggtgccacacttcaatctctcccttctcttaatttcagttcctttccttttctggtagagacaaaggagacccgttttatccatgaacccgatactctggcaccagtcacagactcgggaagacagtcttcccttggtgtttaatcacgcggggatgcttgcctgattattcacccacgtttcagaggtgtctgaccacgtggggacgcctgccttggtccttcacccttagaggcaagtaccgcttttctgaggggcaagaaccccctgaccccttctctctgtgtctctaccccttcaccactttcctggggggcaagcactccacaccccttcactccgtgtctctaccctctcttttctctggacttgcctccttcactaaaggcaaccttccaccctctattccttcttctcccttagcctgtgttcttaaaaacctaaaacctcttcaactcacacctgacctaaaacctaaatgccttattttcttctgcaatgctgcttgaccccaatacagactcgacagtggttccaaatagccagaaaatggcactttcaatttttccatcctacaagatctaaataattcttgtcgtaaaatgggcaaacagtctgaggtgcctgatgtccaggcattcttttacacatcggtcccttcctagtctctgttcccaatggaacttgtcccaaatcttccttctttccttcccgcctgtcccctcagtcccaaccccaagcgtcactgagtctttctaatcttccttttctacagacccatctgacctctcccctcctcaccaggccgagctaggtcccaattcttcctcagcctctgctcctccaccctataatccttttatcatctccccctcctcacacccggtccggctaacagtttcattccgccacctgtccagcaatttcctcttaaaaaggtggctggagctaaaggcatagtcaaggttaatactccctttttctttatctggtctctcccaaatcagttagtgcttaggctctttttcatcaaatatgaaaaacccagcccagttcatggcccctttagcagcaaccctgagacgctttacagccctagaccctgaaaggtcagaaggccgtcttattctcaatatgcattttattttattacccaatctgctcccgacattaaataaagctccaaaaattaaattccagccctcaaaccccacaataggacttaattaacctcaccttcaaggtgtacaataataaagtagaggcagccaagtagcaatgtatttctgagttgcaattccttgcctcccctgtgagacaagccccagccatatctccagcacagaagaactccaaacgcctgaaccacagctgccaggggttcctccagaacctcctcccccaggagcttgctacaagtgctggaaatctgtccactgggccaaggaatgcccacagcccgggattcctcctaagccatgtcccatctgtgcagtaccccgctgaaaattggactgttcaactcacctggcagccacttccagagcccctggaactctggcctaaggctctctgattgactccttcccagatcttctcggctcagcagatgaagactgacacttcccgattgcctcggaagcctacaggaccatcacagatgctctgggtaattatcacagtggagggtaagtccatccccttcttaatcaatatggaggctacccactccacattaccttcttttcaagggcccgtttcccttgcctccataactgttgtgggtattgacggccaggcttctaaatctcttaaaactccccaactctggtgccaacttagacaatactcttttaagcactcctttttagttatccccacctgcccagttcccttattaggccgagacactttaactaaattatctgcttccctgactattcctgggttacaccgacacctcattgccgccttttcccccagttcaaagcctccttcacatcttccctttgtatctccccaccttaacccacaagtataggacacctctactcccaccttagcgactgatcatgcaccccttaccatcccattaaaacctaatcacccttaccccactcaatgccaatatcccatcccacagcatgctttaaaaggattaaattctgttatcattgcctgttacaccatggcctttcaaagcctataaactccccttataattcccccattttgcgtgtcctaaaaccagacaagtcttacaggttagttcaggatctgcaccttatcaaccaaattgttttgcctatccaccctgtggtgccaaactcatatactctcctatcctcaatacctccctccacaacccattattctgttctggatctcaaacacgcttttttactattgctttgcacccttcatcccagcctctcttcgctttcacttggactgaccctgacacccatcaggctcagtaaattacctagcctgtactcccgcaaggcttcacagacagcccccattacttcagtcaagcccaaatttcttcctcatctgttacctatctcagcataattctcataaaaacacacatgctgtccctgccgatcgtgtctgactgatctctcaaaccccaacgccttctacaaaacaacaactcctttcctttctaggcatggttggatacttttgacttcagaaacctggttttgtcatcctaataaaaccattatataaactcacaaaaggaaacctagctgaccccatagatcctaaatcctttccccactcctctttccattccttgaagacagctttagagaatgcccccaccctagctctccatgactcatcccaacccttttcattacccacagctgaagtgcagggctgtgcagtcagaattcttacacaagaacttggaccacgccctgtagcctttttatccaaacaacttgaccttactgttttgcctagccctcaagtctgcatgcggtggccgctgccgccctaatacttttagaggcccttaaaatcacaaactaggctcaactcactctctatagttctcataacttccaaaatctattttcttcctccctcacacctgacacatatactttctgctacccagctccttcagctgtactcactctttgttgagtatcccacaattaccattgttcctggcccggacttcaatccggcctcccacattattcctgataccacacctgacccccatgactgttatctctctgatccacctgacattcaccccatttccccatatttctttctttcctgttcctcaccctgatcacacttggtttattgttggcagttccaccaggcctaattgccacacaccagcaaaggcaggctatgctatagtagaagccactagcccgcctcttagaacccctcatttcctttccatcatggaaatctatgctcaaggaaataacttctcagtgttccatctgctattctactactcctcagggattattcaggccccctcccttccctacacatcaagctcgtggatttgcccccacccaggaatgacaactcttaactccctgttagagtggactgatgatctttgctggcaggggaccctccaatactttcaccctgatgaagttctgttctttacttttatactcactcttattctcattcctattctcatgctaccctctacctctccccagctatctccaccacactatcaatctcactcactctctcctagccatttgtaatccctccttagtgaacaaacgctggctttgcatttccctttcttctagcgcctacacagctgtccccgccttacatgcagactaggcaacatcccctgtttccctacacctccgaacttccctcccgaagaactcatttactttctagacaggtccagcaagacctccccagacatttcacatcagcaagctgccgcccccctccgtacttacttaaaaaacttttctccttatgtcaactctactcctcccatatttacacttctcacaacacaaactactactcctgtggccactcctttatgtatctttgggcaaagacccactggaattcccctaagtaacctttcaccttctcaatgttccttcactcttcatctccaaagcctaactacacacatcactgaaacaattggagccttccagctccgtattacagacaagccctctatcaatactggcaaacttaaaaacattagcagtaattattgcttaggaagacaccctgtatttcactccatccttggctaccttccccttgctcatcagactctcctcccaggccctcttcttgtttacttatacccagccccgaaaataacagtgaaaggttgctcgtagacactcgacgattttctcttacaccatgaaaattgaacctccccctctacgtagttacctcatcagtccccattacaacctctgacagctgccgtcctagctggatccctaggagtctgggtacaagacacccctttcagcactccttctcatctttttactttgcatctccagttttgcctagcacaaggtctattcttcctctgtggatcctctgcctacacgtgtctacctgctaattggacaggcacatgcacactagtttttcttagtcccaaaattcaatttgcaaataggaccgaagagctccctgttccccctcatgacaccaacatgacaaaaaagagttattccatgaattcccttgcttgtcagtttaggactttctgcctccactattgctctcggtactggaatagcaggcgtttcaacctctgtcacgaccttccacagcctctctaatgacttctctgctagcatcacagacatatcacaaactttatcagtcctccaggcccaagtttactctttagctgcagttgtcctccaaaaccgctgaggccttgacttactcactgctgaaaaaggacaactctgtatattcttaaatgaagactgttatttttacctaaatcaatctgacctggtgtatgacaacataaaaaaacttcaggatagagcccaaaaacttgccaaccaagcaagtaattacgctgaaccccccttgggtactctctaattggatgtcctgggtcctcaattcttagtcctttaatacctgtttttctccttctcttattctgtttagtttttcaattcatacaaaaccatatctaggccatcaccaataattctacatgacaaatgtttcttctaacaaccccacaatatcatcccttaccacaaaatcttccttcagcttaatctttcccactctaggttcccacacctccccaatcccgcttgaaacagccctgagaaacatcgtccatttctctccatatcactcccaaaaattttcaccaccccaacactcactttaccactatttcgttttatttttcatattaatataagaagacaggaatgtcaggcctctgagcccaagctaagccgtcatatcccctgtgatctgcacgtacacatccagatggctaattcctgccttaactgatgacattccaccacaaagaagtgaaaatggcctgttcctgccctaactgatgatattaccttgtgaaattccttctcctggctcatcctggctcaaaagctcccctgctgagcaccttgtgacccccccacccctgcccaccagagaacaaccccacttttttcctttacctacccaaatcttataaaacggccccacccctatctcccttcgatgactctcttttaggactcagcctgcctgcacccaggtgattaaaaagctttatttctcacacaaagactgtttggtggtctcttcacatggacgcgagtgaaa

SEQ ID NO: 123 - DNA, 7476 bp, Homo sapiens
cttcccccttagcctgtgttcttaaaaacctaaaaccccttcgactaacacctgacctaaaacctaaacatcttattttcttctgtaatactgcttggccccagtacaaactcgacaatagttccaagtggctagagaatggcacttttgatttgtctatcctacaagacctagataatttttgttgaaaaatgggcaaatggtccgaggtgccttatgtccaggcatttttttacaattcattccctccctagtctctgctcccaatgccacttgtcccagattttccttctttctctcccatccactcctcttgtctccaccccaaactcagagtcctctgaatcctccttttccactgacccctcttacctctcttctcccccggctgctccttgccaggctgaatcaggtcccaattcttccatagcctccgcttccccaccctataacccttctattaccttccctcctcacacctggtctggcttacagtttcgttccgtgactaggtctcccccacctgcccaacaatttcctcttagagaggtggctggagctgaaggcatagtcagggtacatgtgcctttttctctatcagacctttcccaaatcagtcagcattttggctctttctcatcagaccccaataaatatatacaggaattccaatatctaactcagtccttcactttaacctggagtgacttaaatgtcatcctgacctctaccctctccccagataaatgagaaagagtttattctctagcccagtcctatgcagacacctgccggcttcataagccaggcctccaagagggcactagggcagttccccgagaggatccccattggcaataccacacagactccccaggtatagctaggtgagattacatggtctcctgcctagtctaggggctcaaaaaggcagcatacaaagctgttaattatgacaagctaaaggaaactacccaacgtgaagatgaaaacccagcccagttcatggcccacttagcagctacccttagatgctttacagccttagacccagaggggccagaaggccgccttatccttaacatgcattttatgacccaatccactcctgacattagaaaaaaactccaaaagttggattccggccctcaaaccccacaataggatttaatcaacctcaccttcaaggtgttcaataacagagaagaagccgccaagtggcaacgtatctctcagttatagctacttgcctccactgtaagacaacccacaaccacgtctccagcatacaaaaccttcggaacatccaagccacagctcccaggggctccttcaaaacctccctgtggaccttgcttcaaatgccaaaagcctggccactgggcctcggagtgccagcagcccaggattcctcctaagtcgggccctgtctgtgcaggcccccactggaagtcagactgtctgactcacatcgctgccactcctaaagctcctggagctcaaacccaacattccttggccgactccttcccagatctcctcggcttagcagctgaatgtcgatgctgcctgatcgcctcagaagccccctggaccatcacggatgccgagctttgggtaactcttacagtggatggtaagtccataacctgtttaatcgatacgggagctaccccctccacattaccttcttttcaagggcctgtttcccttgcccccgtaactgttgtgggtattgacggccaggcttctagaccccttaaaagtccccaactctggtgccaacttggataacattcttttatgcactcttttttagttatccccacctgcccagttcccttattaggccgagacattttaactaaattatctgcttcccttgcttccctgactattcctggactacagtcacacctcattgctgcccttttacctgattcaaggcctcctttgaatcctcctctcatgtctccctaccttaatccacaagtatgggatacctctactccctccttggtgactgatcaggtaccccttaccatcccattaaaacctagtcactcttaccccgctcaatgccagtaccccatcccacaacaggctttaagaggactaaagcctgttatcactcacctgttacagcatggctttttagagcctataaattctccttacaactcccctatcctaccagtccagaagctggacaaatcttacatgttggttcaggatcttcaccttattacccaaattgtcttacctgtccatactgtggtgccaaacccatatactctcctatcctcaatacctccctccacaactcattattccatcctcgacctcaaagatgctttcttcactattcctttgtacccctcatcctaaccttttttcgctttcacatggactgaccctgacacccaccaatctcagcaactcacctggactgtactgccacaaggtttcagagacagcccccattactttagtcaagctctttctcatgatctactttctttccatccatctgtttctcaccttattcaatatatggacgaccttctcctctgcagctcctcttatttatttattttttttgagatggagtcttgctctgttgcccaggctggagtgcagtggcaagatctcggctcactgcaagctccacctcccaggttcaggccattctcctgccgcagcctcccgagtagctgggactacaggtgcccgccaccatgcccggctactttttttgtatttttagtagagacagggtttcaccatgttagccaggatggtctcgatctcctgaccttgtgatctgcctgtctcggcctcccaaagtgctgggattacaggcgtgagccaccacgcctggcctgcagcccttcttatgaatcttcccaaaaagataccctcctgcttcttcaacatatattctcaaaggggtgtcatatatccccctctaaagcccaaatttcttccccatccattacctatcttggcagagtccttcatcaaagcacacatactctccctgctaactgtgtacagctaatctccaaaaactccaaccccttctacaaagcaacaactcctttccttcctaggcatggttggatactttcgcctttggataccaggttttgccatcctaactaaaccactatataaactcacaaagggaaacctgactgaccccatagacctaagtcctttccccactcttcttttcattccttaaagacaaccctagaaacagtccccacattagcactccctaactcgtcccaatccttcttattacatatagctgaaatacaaggctgtgcgttcagagtttttacacaggatccaggcccatgacctgtagccttcctgtccaaacaacttaacctcacagttctaggctggccctcatgtctacgtgcagcagcagctgccgcttcaatacttctggaggacctcaagctcacaaaccatgccccacttactctctacagctctcataactttcaacatctattttcctactcacacttggtgtatatactttccaccccctaactcctccaactctactcacaattcattgaaactcccacaattaccattgttcctggcacagacttcaccccatcctctcaccttatacccagcaccaaacctgaatctcatgattgtatctccctaatccatgtggcatcctccccatttccccatatttccctctttcctgttcctaatccagaccacacttggtttattgatggtagttcttcaaggcccaatcatcagtcaccagcaagggcaggctatgctgtagtgtcttccacatctgtcattgaagctactgccttgcccccttccactacctctcaacaagccaaactcattgctttaaactgggcccacacccttgcaaagggactatgtgtcaatatctacactgattccaagtatgccttccacatcctacatcaccatgctgttatatgggcagaaagaggttttctcactacacaagggtcctccatcatcaactgcctttataaaaatcctccttaaggctgctttactgcccaaagaagctgaagtcattcactgcaaggggcatcagaggtcaccagatcccattgcttgaggcaacacttatgctgatatgcagcaaaagaagcagctagtattcccacatctgtccctcacagccagttttcttccttctcatctatcactcccacctattctcccactgaaactattacctattaatccattcctactcatgaaactattacctattaatccattcctactcaaggcaaatggttcttggatcaaggaaaattcctccttcctgcctcacaggctcattctatcttatcatcctttcagaacctctttcatgtgggttacaagccaatggcccatctcttagaacctctcatttcttttccatcatggaaatccatcctcaaggaaattacttctcagtgttccatctgctactctaccaccactcagggatatctcacgccccctccctttcctacacatcaagctagaggatttgccccaacccaggactggcagactgactttacccatatgccccaagtcaaaaactaaggtaccttttggtctgggtagatacattcactggatgggtagaggccttttccacagggtctgagaaggccaccacagtcgtttcttcccttctgtcagacataattcctcggtttggccttctgacctctatatagtctgataatggaccggccttcattagtcaggtcacgtaagcagtctcccaggctctcagcatccagtggaaacttcatacccccttaccatccttcatctttgggaaaggtagaaagaactaatggtcttttaaaaacacacctcaccaagctcagcctccaacttaaaaaagactggacagcacttttaccatttgccctccttagaattagagcctatcctcaagaagctacaggatatagtccatttgaactttcatacggatgtactttcttgctgggccccaacctcttgacagacaccagccctctaggcgactatcttctggtactccagcaggctagacaggaaattctccaggctgctaatcttttcttgcctactccagattcccagcaatatgaagacaccctagctggatgatcagttcctgttaagaatatgacccctcaaaccttgatggactggaccctgcttagtcatctatagtaccccaactgctgtctgcctgcaggaccctctgtattgggttcaccattccagaataaagctgtgtctgccagccagccagcctgatctctcctcttcctcctggaaatcgcaagtactctcccctgcttcccttaaactcacttgcatttctgaagaacagtaataacccttatgagcctaatatatcccttcattctattaggtctattcatccttaccctactttttgcaacagggctttacacagtcacccccactacttggactgtgccccaaaaacttgtcatccctactatcttctgtctagtcatactcctattcaccattctcaactactcataaatgccctgcccttgtttacactgccagtttacacttttcctccaaaccatcataactgatatctcctggttttacctcaaaccgccacccttaactctctctgggagtggatagaagctcttcagtggcaaggtacactccaattcctctatcctgataaagtccttttttttttttttttttttacttttctacttactcttatccttgaccccattctccagtcactatctacctctccctagttacctccagcatactatcaatctcacccactctctcctcactgcctccaatccttctctagcaaagaattgttggctatgtgtttccctttcttcctgctcttacaagtccccgctctacaggccgactgggctacctctcctgtctccctgcacctccaaacctcctttacctcatctttaccctcctgaggaacttctttactttctagacagatttggtgagaactccccagacatttcacaccaacaagctgccacacttctccgcatctacttatggtacctttctccttatgtcaagtccacccccccccaaatttggacccctaaccacacaaacaactatccctgttgctgctcctttttgcatctcctgaccacagcctactggaatccctttaggcaaccttccaccgtccaaatgttcctttactctttatctccagaacccagccacacacactaccaaacagatgggagcattccaacttcgcattgctgataagccctctatcattattgacaaactaaaaaacattggcagtcactattgtttaggaagacacctaccctgcatctcactccatccttggctaccctccgcttgctcatctgactctcctcctgactcctcctcttgcttgcttatacccagccccatcaatagcagtgaaaggttactcatagatactatgctctttctcatataccatgagaaccaaacctttcatctacacaattgcaccatcaatccccattacaacctctaacagctgctgtccttgctggatctctaggatttggggtgcaggactcctctttcagtacaccctctcaccttttcactttacatttccagttctgcctgacacaaggtttcttctttttatgtggctcttccacctacatgtgcctacctgccagctagatgggcacatgtactctagtcttccttactcccaaaatccagtttgtagatgggaatgaacaactgcctgtccccctcatgacaccaacatgacaaaaaagagtcatctcactaatccctttgcttgtgggtctaggactttctgcctccactcttgcacttggaactggaatagcaggcatctcaacctctgtcacagcattccgcagcctctctaatgacttctctgctagcattacagatatatcacaagctttatctgtcctccaagcccaggttgactctttagctgcagttgtcctgcagaaccgccaaggcctcaatttactcactgctgaaaaaggaggactctgtatatttcttaatgaagagtgttgtttttacttaaatcaatctggcctggcatatggtaacatcaaaaaactcaaagacagagctcaaaaactcactaatcaggcaactaattatgctggacccacctggtcactctctaactgggtatcctggcttgttccaatcattagtcctgtaatacctatcttcctccatctcttattcgggccttttgtcttccgattaatctctcaattcctacaaaactgcatccaggctatcactaatcactctatatgacaagtgctgcttttaacaagcccacaatatcaccccttaccccaaaatcttacttcagtctaa

SEQ ID NO: 124 - DNA, 171 bp, Homo sapiens
ttacagtaggtagctagtcagatatgagcagggcaggaaagggccccctgcctcccactaggaatgtcaggcgaccatcaggtgatggttggaggttgttaaactgcctctctaaaataataattggtcgtagccagcgccagggaaaggcagtctcccaacagattaaaa

SEQ ID NO: 125 - DNA, 1225 bp, Homo sapiens
atggtaaatatgtatacagactctaagtatgcttatctagtcctccatgcccactcagcaatatggagagaaaggaaattcctaacttccaagggaacacctatcaaatatcaggaagccattaggagattattattggctgtacagaaacctaaagagttggcagttttacactgctggggtcatcagaaaggaaaggaaagggaaatagaagggaaccgccaagcggatattgaagtaaaaagagccgcaaggcaggaccctccattagaaatgcttatagaaggacccctagtatgtggtaatcccttctgggaaaccaagccccagtactcagcaggaaaaatagaatagggaacctcacgaggacatagtttccttcgctcaggatggctagccaccgaagaagggaaaatacttttgcctgcagctaaccaatggaaattacttaaaacccttctccaagcctttcacttaggcattgatagcacccatcagagggccaaatcattatttacaagaccaggccttttcaaaactatcaagcagatagtcagggcctgtgaagtgtgccaaagaaataatcccctgcgctgcaggccatacatttcaatccctgtatctttaacctccttgttaagtttgtctcttccagaatcgaagctgtaaaactacaaatagttcttcaaatggagccccagatgtagtccatgactaagatctaccacagacccctagaccagcctgctagcctgtgctctgatgttaatgacatcgaaagcacccctcctgaggaaatctcaactgcacaacccctactatgccccagttcagcaggaagcagttagagcggtagtcggccaacctccccaactgcacttgagtttttcctgttgagagcggggactgagagacaagactagctggatttcctaggccgactaaaaatccctaagcctagctgggaaggtgaccgtgtccacctttaaacacggggcttgcaacttagctcacacccaaaccaatcagagagctcactaaaatgctaattagacaaaaacaggaggtaaagaaatagccaatcatctatcacctgagagcacagcaggagggacaatgaccgggatataaacccaagcatttgagccagcaatggcaaacccctttgggtctcctgcctttgtatgggagctctgttttcactctattaaatcttgcaactgca

SEQ ID NO: 126 - DNA, 976 bp, Homo sapiens
ttacagtaggtagctaatcagacatgagcaggacagaagagccccaccaccaacaaccaggagtgtcaggtgaccatcaggtgataggcagtttgttaactgtctttctttttttctttatttttttttttagatggagttttgctcttgttgcctaggctggagtataatggtgcaatctcggctgactgcaacctctgcttcccgggttcaagtgattctcccacatcagcctcccaagtagctgggattacaggcacccaccaccaaacccagctaattttttttttttttttttttagtaaagaacatccacctgccttggcctcccaaattattgctgggattacaggtgtgaaccacggccgctggccttaactgtctttctaaaataataattgattgcagccagcaccagggaaaggcagtctcccaataaacagaaacacctgaaactggtgatcagctgcttcctggtaagatttcaggagttaggtgagtgcactcatgcacgtacactaaaaggcaaaatggcagaatttaactggtatatgaccttctctaggaatgctagagattggtaagggaagaatgtctctagtgagcatgcgtataactccagtaaacacactgtatttgtggctggcccctcgcaagggctaacaggccattgtgcatgcagacagcccaccccaggggaagaatcaggggcagaaggcacgcaaggccctggaagcatgccaacgtataaaaccccaagtcagaggtcaaacagagcacttgatctctcaagctgcccacttggccctcttccaattatacttcttttcattcctgctctaaatctttttaataaactttccctcctggtctaaaacttgcctcggtctctccttctatcttgggcccctcagtcgaattctttcttctgaggaggcaagaatcgaggttgctgcagaccagtacagattcgtca

SEQ ID NO: 127 - DNA, 5934 bp, Homo sapiens
gtcagggctctgagcccaagccaagccatcgcatcccctgtgacttgcatgtatacgcccagatggcctgaagtaactgaagaatcacaaaagaagtgaaaaggccctgccctgccttaattgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaatggccccacccctatctcccttggctgactctcttttcagactcagcccacctgcacccaggtgaaataaacagctttattgctcacacaaagcctgtttggtggtctcttcacatggacgcgcatgaaatttggtgccgtgacttggatcaggggacctcccttgggagatcagtcccctcctcctgctctttgctccatgagaaagatccacctatgacctcaggtcctcagactgaccagcccaagaaacatctcaccaatttcaaatctggtaagcggcctctttttactctcttctccaacttccctcactatccctcaacttctttctcctttcaatcttggcgccacacttcaatctctcccttctcttaatttcaattcctttcattttctggtagagataaaggagacatgttttatccgtggacccaaaactctggcgccagtcatggactgggaaggcagccttcccttggtgtttaatcattgcagggacgcctttctgattattcatccacgtttcaaaggtgtcagaccacgcagggacgcctgccttggtccttcacccttagtggcaagtcccacttttctgggggaggggcaagtaccccaaccccttctctccatgtctctaccccttctctgcttttctgggggaggggcaagtacccctcaaccccttctccttcacccttagcggcaagtcccgcttttctgggggaggggcaagtaccccaaccccttctcttggtgtctctatcccttctctgcttttctgggggaggggcaagtaccccaaccctttctctctgtgtctctaccccttctctgcttttctgggggaggggcaagtaccccaacaccttctctccgtgtctttaccccttctctgcttttcttggggaggggcaagtacccctcaaccccttctccttcaccctttgcggcaagtcccgcttttctgggggaggggcaagtacccctcaactccttctccttcaccgttagcagcaagtcccgcttttctagggggcaagaacccccaatccgttattcccacaccccgacctcttatctctgtgccccaatcccttatttctgtgccccaaccctttctctgcttttctgggaggcaacaaaccctcactccttctccgtgtctctactcttttctctgggcttgcctccttcactatgggcaagcttccaccttccattcctccttcttctcccttagcctgtattcttaagaacttcagacctcttcagctctcacctgacctgaaatctaagcgtctttttttcttctgcaatgccgcttgaccccaatacaaactggacagtagttccaaatagctggaaaatggcactttcagtttttccatcctgcaagatctaaataattcttgtcgtaaaatgggcaaatggtctgaggtgcctgatgtccaggcattcttttacacatcagtcccttcctagtctctgtgcccagtgcaactcatcccaaatcttccttctttccctcccacctgtcccctcagtcccaaccccaagcatcgctgagtctttctaatcttccttttctacagacccatctgacctctcccctcctcgccaggccaagctaggtcccaattcttcctcagcctccgctcctccaccctgtaatctttttatcgcctcccctcctcacacctggtctggcttacagtttcgttcagtgactagcccttccccacctgcccagcaatttattcttaaaaaggtggctggagctaaaggcatagtcaaggttaatgctcctttttctttatcccaaatcagatagcgtctaggctctttttcatcaaatataaaaatccagcccagttcatgactcgtttggcagcaaccctgagacgctttacagccctagaccctaaaaggtcaaaaggccatcttattctcaatatacattttattgcccaatctgctcccgacattaaataaaactccaaaaattggaatctggccctcaaaccccacaacaggacttaattaacctcaccttcaaggtgtgcaataacagaaaaaagttgcaattccttgcctacactgtgagacaaacctcagccacatctccagcacacaagaacttccaaacacctgaactgcagcagccaggcattcctccagaacctcctcccccaggagcttgctacacatgctggaaatctgccactgggccaaggaatgcccacagcacggtattcctcctaagccacgtcccatctgtgtgggaccccaccgaaaatcggactgttcatctcacctggcagccactcccagagcccctggaactctggcccaaggctctctgactgactccttcccagatcttctcggcttagcggctgaagactgacactgcccgatcacctcggaagccccctaacccatcacagacgctgagatttgggtaactctcacggtggaaggtaagcccgtccccttcttaatacagaggctacccattccacattaccttctttttaagggcctgtttcccttgcctccataactgttgtgggtattgacggccaggcttctaaacctcttaaaactccccaactctggtgccaacttagacaatactcttttaagcactcctttttagttatccccacttgcccagttcccttattaggctgagacactttaactaaattatctgcttccctgactattcctggactacagctatatctcattgccacccttcttcccaatccaaagcctactttgcgtcctcctcttgtatccccccaccttaacacagaagtataagatacctctactccctccttggcaaccgatcatgcaccccttaccatctcattaaaacctaatcacccttaccccgctcaatgtcaagatcccatcccacagcacactttaaaaggattaaagcctgttatcactcgcctgctatagcatggccttttaaagcctataaacgcttcttaccattcccccattttacctgtcctaaaaccagacaagacttacaagttagttcagaatctgcgccttatcaaccaaattgttttgcctatccaccccgtggtgccaaacccatatactctcctatcctcaatacctccctctactacccattattctgttctagatctcaaacatgctttctttactattcctttgcacccttcatcccagcctctccttgctttcacttagactgaccctgacacccattaggctcagcaaattaccaaggctgtactgccgcaaggcttcacagacagcccccattacttcagtcaagcccaaatttcatcctcatctgttacctatctcggcataattctcataaaaacacacatgctctccctgctgatcgtgtccgattaatctcccaaacctcaatcccttacaaaacaacaactcctttccttcctaggcatggttagtgcggtcagaattcttacacaagagccagcaccgcaccctgcagcctttctgtccaaacaacttgaccttactgttttagcctagccctcatgtctgcatgcagcggctgccactgctttaatacttttagaggccctcaaaatcacaaactatgctcaactcactctctacatttctcataacttccaaaatctattttcttcctcatacctgacgcatatactttctgctccccggctccttcagctgtactcactctttgttaagtcccacaattaccattgttcatggccaggacttcaatccagcctcccacattattccagataccacacctgatcttcatgactgcatctgtctgatccacctgatgttcatcccatttccccacatttccttcttccctgcttctcaccctgatcacgcttgatttactgatggcagttccaccaggcctaatcaccatacaccagcaaaggcaggctatgctatagtacaagccactagcctgcctcttagaacctttcatttcctttccatcatagaaatctatcctcaaggaaataacttctcagtgttccatctgctattctatctgctattctactactcctcaaggattattcaggccccctcccttccctacacatcaagctcgaggatttgtccctgcccaggactggcaaattagctttactcaacatgccctgagtcagataactaaaatacctcttagtctaagtagacactttcactagataggtagaggcctttcctacagggtctgagaaggctaccgcagtcatttcttcccttctgtcagacataattcctcagtttagccttcccacctctatacagtctgataacagaccaacctttattagtcaaatcagccaagcattttttcaggctcttagtattcagtgacagactaatggtctattaaaaacacacctcaccaagctcagccaccaacttaaaaaggactggacaatacttttaccactttcccttctcagaagtcagacctgtcctcagaatgctacaaggtacagcccatttaagctcctgtatagatgctcctttttattaggccccagtctcattccagacaccagaccaacttagactgtgcccccaaataacttgtcatccctactatcttctctctagtcatactcctattcaccgttctcaactactcatacatgccctgctcttgtttacactgctggtttacactgtttctccaagccatcacagctgatatctccttgtgctatccccaaactgccactcttaactcttgaagtaaataaataatctttgctggcaggactatgacgaagctctgtaggcactctctaattagatgtcctaggtcctcccaattcttagtccttttatacctgtttttctccttctcttattccatttagtttttcaattcatacaaaaccgtatccaggccatcaccaatcattctatacgacaaatgtttcttctaacaaccccacaatatcaccccttaccacaaaatcttccttcagcttaatctctcccactctaggttcccacaccacccctaatcccgcttgaaggagccctgagaaacatcgcccattctctctccataccgccccccaaaaattgtcgccgacccaacgcttcaacactattttgttttatttttcttattaatataagaaggcaggaatgtcaggcctctgagcccaagccaggtcattgcatcccctgtgacttgcacatatatgcccagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaattttccattacctttccaaatcctataaaatggccccaccgctatctcccttggctgactctcttttcggactcagcccacctgcacccaggtgaaataaacagctttattgctcacacaaagcctgtttggtggtctcttcacacggatgcgcatgaaa

SEQ ID NO: 128 - DNA, 463 bp, Homo sapiens
gtaggagattggtcagggtggtgggaacaattgtagaaagatgcaaaccttggaaggccaggggtttgcaaagcttctaaagaaaatttggctgaaggcagctgaattctcttaagagcttaggttaggtaacaaggggatgtaaagaaactgatctagataagtgagtttacttaggccccagaacctggcctttaatcgtctgcgagcaggactgctctgggtggtggggggagggtgaccatgttaattatccacaagtgtgttgactcaaagcctttgtcattaaatttgtgctgaataaatgcctgcggcaccagccagccgtggctgctgactctttacagtaccctccttggggtctgtaagcggcccggttccctaacccactctttcactagatatctgtgtctgagtgcatttgttcatccatcatttggccagggtctgcgggtctgaccca

SEQ ID NO: 129 - DNA, 105 bp, Homo sapiens
tctgcggctgctgaaacctgggaggcaaaaccgagcccggacaacccctgcaaagtaactctgaggaagatgacaagcccagctccagtcatacctggaagctga

SEQ ID NO: 130 - DNA, 7636 bp, Homo sapiens
gggtcagatacaaagtaagcctactcccctaggaactatgttgaaaaattttaagagaggatttaatggagactttggggaacttagaactttgtgtgaaatagattggccaacattagaagtaggatggccatcagaaggaagcctggacaggtcccttgtttctaaggtatggcacaagataactggtaagtcaggacactcagaccagtttccacacatagacacttggttacagctgatgctaaaccccccacagtggctaagagggcaggcagcagcagcgctagtagcaaagtgacagatagccaaggaaggatcccgctccacccgccgagggaaatcaactcctgaagttctgttcgacccagcatcagaagatccattgcaggagatggcaccagtgatctcagtggtgccctctccttaccagggaggcaggctccccacttttgagtccacagtgcttgtgcctccacaagacaaacatatccctaggccacccagagtagacaagagaggaggtgaggactcgggagaaacccctcccttggcagctcgtttaagacccaaaacggggacacaaatgcccctgagagagcagcggtatactgggatatatgaggatggtcacgtggtggggaggcgtgtttttgggtaccagcccttcacctctgcccactttctcaactggaaagacaataccccatcctgtaccgaaaagccacaagctctgattgatttgctccaaactattatccagacccataaccccacctgggctgattgccaccagttgctcatgttcctctttaacacagatgaaaggtggagagtgctccaagcggcaactaagtggctagaggaacatgcaccagctgattaccaaaacccccaagagtatgtaaggacccagttaccaggaactgacccccagtgggacccacatgaaagagaggatatgcaaaggctaaacagagacagggaagctctcttggaaggattaaagaggggagcccagaaggccacaaatgttaacaaagtctctgaggtcattcagagaaaagaagaaagtccagcacaattgtaggagagtctgtgtgaggcctatggtatgtatactccctttgatcccgatagccctgaaaatcaaggcatgattaacatggctttagttagtcaaagcgcagaagacattagaagaaaactgcagaaacaggctgagtttgcagggatgaacacatcacagttattagaaatagctaaccaggcgtttgtaaacagggatgcagtaagccgtaaggaaaactacagagacaatgaacgtcaggcccagcgaaacaccgacctgttagcggcagcaatcagaggggtcccccaaaataggcaagggaaggggggccctgggaaggaaactcagcctggctgtcagagcttgcagcgtaatcagtgtgcttattgtaaagaaataggacattggaaaaacaaatgccctcagctaaaaagaaaacaaggtgactcagagcaggaggccccggacaaggatgaaggcaccctgctcaacctggcagaggggttattggactgagggggactgggctcaaggacccctaaagagcctatggtcaggatgacagttaggggtaaagacattgattttcttgtagatactggagctaaacattcggtagtaaccgccccggtcacccccttatccaaaaagattattgacatcattggagccacaggagtttcagcaaagcaagctttctgcttgccccggacttgtgctgtaggaggacataaagtgattcatcagtttttgtacacacctgactgtcccttgtgcttgttgggaagggacttgcttagcaaactgagagccactatctcttttacagagcatggctctttgctgctaaagtcatgggcagaagacaaccctccaggattggccagttaagcctagggcccagccggttaggcaaaaacaggagccggtccccagagaaactcttgaaggtatccaggtccatctcaagcacctaagaacttttggaatcagagttccttgtcagtctccatggaacactcccctcctgcctgttcccaagcctaagaccaaggactactggccggtacaggatttgcgcttggttaatcaagctacagtgactttacatccagcagtacctaacccgtacacattgctggggttgctgccagctgaggacagctgcttcacctgcttggacctgaaagatgctttcttcagcatcagattagcccctgagagccagaagctgtttgcctttcagtgggaagatccggagtcaggtgtcactactcagtacacttggaccgggcttccccaagggttcaagaactcccccaccatcttcggggaggcattgcctcgagacctccagaagtttcccaccagagacgtagactgcgtgttgctccagtacattgatgatcttttgctgggacaccccacggcagtcaggtgcgccaagggaacagatgctctactccggcacctggaggactgtgggtataagatgtccaagaaaaaagcttagatctgacgacagcaggtacattacttaggatttactatccaaaagggggagagcagcctaggatcagaaagaaagcaggtcatttgaaatctaccggagcctaagacaagaaggcaggtgagagaattcttatgggctgttgggtttagcagactgaagatcccaaactttgcagtataagccaagcctttgtatgaggtcacaaaggggtggggggggggacagggaacgttttgaatggggatcccagcaacagcaagcctttcatgagttaaaggaaaaacttatgtcagccccagccctggagctactcgatctaacaaagccttttccatcgtatgtgtcagagagagaaaagatagcagttggagttttaacccaaactgtggggccctggctgaggccggtggccttcctctctaaacaactagacggggtttctaaaggatggcccccgtgtttgagggccttggcagcaactgccctgctagtacaagaagcagataagctgactcttgggcaaaacctgaacataaaggcctcccgtgctgtggtgactttaatgaatactaaaggacatcattggctaatgaatgctagactcactaagtcctaaagtttgctctgtgaaaatccccgtataaccactgaagtttgtagcacgctgaaccccgctaccttgctcccagtatcagagagccctgtcgagcatgactgtgtagaagtgttgggctcagtttactctagcagacctaacctccaggaccagccttaggcaccagtagactaggaactatacgtggctgggagcagcttcatcaacccacaaggagagagatgtgcaagatatgcggtggtaactctggacactgttgctgaagccagatcattgccccagggcacttcagctcagaaagctgaagtcattgctttcattcgggcctgagaactcagtgaagctaagaatgtcaacatttacactgactctcaatatgccttttcaacccttcaagtgcgtggagcattatataaagaaaagggcctattgaactctgggggaaaagacataaaatatcaacaagaaatcttgcaattgttaaaagccatatggagaccccacaaggtggcagttatgcattgcaggggacagcagcgagcttccaccttgctgggtttagggaattcccccgctgacttagaggctcgaaaagcagcgtctgcccccttccgggcatcagtcacagcccccatgctccctcaagcacctgatcttgtacctacttattctaaagaagaaaaggacttcctccaggcagagagaggacaagtgatggaggaaggatggattcggttaccggaagggagagaagatgcgccacagctgctaggagctgcagttgtactggctgtgcatgaaaccacccatcgaggtcaggagtcaattgaaaagttgttaggccggtatttctacatctcgcatttgtcagctcttgccaaaacggtgacgcagtggtgtgttacctgcccacagcataatgctaggcaatgtccagccgttccacccggcatacaagcttatggagcagccccctttgaagatctccaggtggacttcacagagatgtcaaagtgtagaggtaacaagtatttactagttcttgggcgtacctactctgggtaggtggaggcttatccaacacgaactgagaaagctcgtgaagtaactcgtgtgcttcttcgagatcttcttcctagatttgaactgcccttacggatcggctcagataacaggccggcatttgtggctgacttagtacagaaggcggcaaagatattacggatcacatggaaactgcatgctgcctactggcctcagagttccggaaaggtggagcgaatgaatcaaactatcaaaaatagtttagggaaagtatgtcaggaaacaggattaaaatggatacaggctctccctatggtattatttaaaattagatgtaccacttctaaaagagcaggatattccccttatgaaatattatatcataggccccctcctatattgcggggacttccaggcactccctgagagttaggtgaaattgagttacagcgacagctacaggccttaggaaaaattacacaaacaatctcagcccgagtaaatggcctgttagcttattctccccagttcaccctttctccccaggtgatcgagtgtggatcaagaactggaacgtagcctctttgtgtccactgtggaaaggaccccagactgtcgttctgagccctcccaccgctgtgaaggtagaaggaatcccagcctggatccaccacagccatgtaaaacctgcagcgcgtgaaacctgggaggcaagaccaagcccagacaaccctttcagagtgaccctgaagaagacgacaagccctgctccagtcacacccggaagctgactggtccacgcacggccgaagcctgaggaagctcatcgtgagattcatttttcttaaattttggacttatacagtaagggcttcaactgatcttactcaaactggggactgttcccagtgtattcatcaggtcaccgaagtaggacagcaaattaaaacaatctttctgttctatagttattatgaatgtgtggaaacaataaaagaaacttgtttgtataatgccactcagtgcaaggtatgtagcccgagaaatgaccgacctgatgcgtgttataacccatctgagccctccgcaaccaccgtttttgaaataagaataagaactggccttttcctaggtgatacaagtaaaataataactagaacagaagaaaaagaaattcccaagcaaataactttaagatttgatgcttgtgcagccattaatagtaaaaagctagaaataggatgtggttctcttaactgagaaaggagctaaagagtagaaaataaatatgtttgtcatgagtcaggggtttgtaaaaattgtgcctattggccatgtgttatttaggctacttaaaaaaagaacaaaaaggaaccggtttatcttcagaagggggaagccaacccctcctgtgctgccagtcactgtaacccactagaactaataattaccaatcccctagatccccgttggaaaaagggagaacgtgtaaccctggggatcaataggacagggttaaaccctcaagttgccattgtaattagaggggaggtccacaagtgctctcccaaaccagtatttcaaaccttttatgaggagctgaatgtgccagcaccagaacttctgaaaaagacaaaaaatttgtttctccaattagcagaaaatgtaattttcttacttacataactgttacttcttgttatgtacgcggaggaaccactatcggagacagatggccttgggaagcccaagagttggtgcctactgatccagctcctgatataattccagttcagaaggccgaagctagcaacttctaggtcctaaaaacctcaattattagacaatactgtagagctagagaagggaaagactttatcatccctgtaggaaagcttaattgtataggacagaagttgtataacagcacaatacagacaattacttagtagggcctaaaccacactgaaaagaatccatttagtaaattttctaaattaaaaactgcttaggctcatccagaatctcatcaggactggacggttcccgctggactatactagatatgtaggcacagagcctacattcggttacctaataaatgggcaggcagttgtgttattgacactattaagccatcctttttcttattacccataaaaacgggtgagctcctaggtttccctgtctacgccgcccgagaaaagaaaggcatagttataggaaactggaaggagaatgagtggccccctgaaaggatcattcagtattatgggcctgccacatgggcacaagacggctcatggggataccgaacccccatctacatgctcaattggatcatacggttgcaggccatcttagaaataattactaatgaaactggcagagctttgactgttttagcttggcaagaaacccaaatgaggaatgctatctatcagaatagactggccttagactacttgctagtagctgaaggaggagtttgtggaaaatttaacttaaccaattgctgcctacaaataaatgatcaaggacaggtggttaaaaacatagtcagggacatgacaaaggtggcacatgtgcctgtacaggtttggcacgagtttaatcctgagtctttatttgaaaaatggtttccagctatagcaggatttaaaaccctcattgtaggtgtattgctagtgataggagcttgcttgctgctcccctgtgtattacccttgctttttcaaatgataaaaggttttgtagctactttggttcatcagaaaacttcagcacacgtgtgttatatgaatcagtatcgctctatctcaccaatagactcaaaaagtaaagatgagagtgagaactcccactaaaaagtgaaaatgctcaaaggggggaaatatggtgtgagaccaccacgtctcctgttgtccttcccagtttctccccaacctccccttttccctagtttgtaagacagcaaaaaagggagaaagcaaaaagttggaaaaaacagaagtaaaataaatagccagatgaccttggcgccaccacctggccctggtggttaaaatgacaataatattaacccctgaccaaaactacaggtgttatctgtaaatcccagacattgtatgagaaagcactgtaaaaactttttgttctgttagctgaagtatgtagcccccagtcacgttcctcaggcttacttgatctattatgactttttcacgtagaccctttagagttgtaagcccttaaaagtgctaggaatttctttttcagggagctcggctcttaagacacgagtctaccgacgctcccggccgaataaaaaaacctcttccttctttaatccggtgtctgaggagttttgtctgcaactcgtcctgctaca

SEQ ID NO: 131 - DNA, 5899 bp, Homo sapiens
gtcaggcctctgagcccaagccaagccatcgcatcccctgtgacttgcacgtatacatccagatggcctgaagtaactgaagatccacaaaagaagtaaaaatagccttaacagatgacattccaccattgtgatttgttcctgccccaccctaactgatcaatgtactttgtaatctcccccacccttaagaaggttctttgtaattctccccacccttgacaatgtactttgtgagatccaccctgcccacaaaacattgctcttaacttcactgcctatcccaaaacctataagaactaatgataatccaccaccctttgctgactctcttttcggactcagcccgcctgcacccaggtgaaataaacagccatgttgttcacacaaagcctgtttggtggtctcttcacacggatgcacatgaaatttggtgccgtgactcggatcgggggacctcccttgggagatcaataccccgtcctcctgctctttgctccgtgagaaagatccacctacgacctcaggtcctaagaccgaccagcccaagaaacatctcaccaatttcaaatccagtaagcggcctctttttactctcttctccaacttccctcactatccctcaacctctttcttctttcaatcttggcgctacacttcaatctctcccttctcttaatttcaattcctttaattttctggtagagacaaaagagacatgttttatccgtggacccaaaactccagcgcctgtcatggactgggaaggcagccttccctttgtgtttaatcattgcagggatgcctctctgattatacacccatgtttcaagggtgtcagaccacgcagggacacttgccttggtccttcacccttagcggcaagtcccgcttttcttgggaaggggcaagtaccccaatcccttctctccttgtctctaccccttctctgcttctctggggaaggggcaagtaccccaaccccttctctccttgtctctaccccttctctgcttttctggggaaggggcaagtacccctcaacccccttctccttcacccttagcggcaagtcccgctttcctagagggcaagaacccccccaatcgcttatttctgcaccccaacctcttatctctgtgctccaatcccttatttccacaccctgaccttttatctctgtgccccaatcccttatttccatgccccaaccccttctctgcttttctggagggcaagaaccccccaccccttctccgtgtctctactcttttctctgggcttgcctccttcactatgggtaagcttccaccttccattcctccttcttctcccctagcctgtgttctcaaaaacttaaaacctcttcaactcacacctgacctaaaacctaaatgccttattttcttctgcaatgccgcttgaccccaatacaaactcaacagtagttccaaatagccagaaaatggcactttgaatttttccatcctgcaagatctaaataattcttgttgtaaaataggaaaacggtctgaggtgcctgacatccaggcattcttttacacatcagtcccttcctagtctctgtgcccagtgcaactcatcccaaatctttcttctttccctcctgcctgtcccctcagtcccaaccccaagcgtcactgagtctttctaatcttccttttctacagacccatctgacctctcccctcctcgccaggccgagctaggtcccaattcttcctcagcctccgctcctccaccctataatctttttatcacctcccctcctcacacctggtccggcttgcagttttgttccatgactagccctcccccacctgcccagcaatttaatcttaaaaagccaaaggcatagtcaaggttaatgctcctttttctttatcccaaatcagatagcgtttaggctctttttcatcaaatataaaaatccagctcagttcatgacttgtttggcagcaaccctgagatgctttacagccctagaccctaaaaggtcaaaaggccatcttattctcaatatacattgtattacccaatctgctcccgacattaaataaaactccaaaaattaaattccagccctcaaaccccacaacaggatttaattaacctcaccttcaaggtgtacaataatagaaaaaagttgcaattccttgcctccactgtgagacaaaccccagccacatctccagcacacaagaacttccaaacgcctgaactgcagtggccaggcgttcctccagaacctcctcccacaggagcttgctacacgtgccggaaatccggccactgggccaaggaatgcccgcagcccaggattcctcctaagccgcgtcccatctgtgtgggaccccactgaaaatcagactgttcaactcacctggcagccactcccagagcccctggaactctggcccaaggctctctgactgactccttctcagatcttctcggcttagtggctgaagactgacactgcccgatcgcctcggaagccccctaaaccatcacggatgccgagcttccggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactaactaaattatctacttccctgactattcctggactacagctatatctcattgccacccttcttcccaatccaaagcctcctttgcatcctcctcttgtatccccccaccttaacccacaaatatgagatacctctactccctccttggcgactgatcatgcaccccttaccatctcattaaaacctaatcacccttaccccactcaacgccaatatcccatcccacagcatgctttaaaaagattaaagcctgttatcactcgcttgctacagcatggccttttaaagcctataaactttccttacaattcccccattttacctgtcctaaaaccagacaagccttacaagttagttcaggatctgctccttatcaaccaaattgttttgcctatccaccccatggtgccaaacccatatactctcctatcctcaatacctgcctctacaacccattattctgttctagatctcaaacatgctttctttaccattcctttgcacccttaatcccagcctctcttcactttcacttggactgaccctgacacccatcaagctcagcaaattacctaggctgtacggctgcaaagcttcacagacagcccccattacttcaatcaagcccaaatttcttcctcatctgttacctatcttggcataattctcataaaaacacacgtgctctccctgccaatcgtgtctgactgatctctcaaaccccagcaccttctacaaaacaacaactcctttccttcctaggcatggttagtgcagtcagaattcttacacaagagccaggaccgcaccctgtagcctttctgtccaaacaacttgaccttactgttttagcctagccctcatgtctgcgtgcagtggctgccgctgcattaatacttttagaggccctcaaaatcacaaactatgctcaactcactctctacagttctcataacttccaaaatctattttcttcctcatacctgacgcatatactttctgcttcccagctccttcagctgtactcactctttgttaagtcccacaattaccattgttcctggcccagacttcaatctggcctcccacattattcctgataccacacctgacccccatgactgtatctctctgatccacctgatattcaccccatttccccatatttccttctttcctgttcctcaccctgatcacgcttgatttattgatggcagttccaccaggcctaatcgccacacaccagcaaaggcaggctatgctatagtacaagccactagcccgcctctcagaacctctcatttcctttccatcgtggaaatctatcctcaaggaaataacttctcagtgttccatctgctattctactacccctcagggattgttcaggcctcctccctttcctacacatcaagctcgaggatttgcccctgcccaggactggcaaattgactttactcatatgcctcgagtcagaaaactaaaatatctgttagtctgggtagacaccttgactggatgggtagaggccttccccacagggtctgagaaggccaccacagtcatttcttcccttctgtcggacataattcctcggtttggccttcccacctctatacagtctgataacggaccagcgtttactagccaaattacccaagcagtttctcaggctcttggtattcagtggaaccttcatatcccttaccatcctcaatcttcaggaaaggtggaacggactaatggtcttttaaaggcacacctcaccaagctcagcctccaacttaaaaaggattggacagtacttctacctcttgctcttctcagaatcagagcctgtcctccagatgctacagggtacagtccatttgaacttttatagggatgcactttcttgcttggccctaacctcatccagacaccagccctctaggcgactatcttccagtcctccagcaggctagacagcaaattcgccaggctgctaatcttctcttgcctactccagatccccagccatatgaagacaccctagctggatgatcagttcttgttaagaatctgacccctcaaactctacaacctcgatggaccggaccctacttagtcatctatagtaccccgactgccatccgcctgcaggatcctccccactggtttcaccattccagaataaagctgtgtccattggacagctagcctaatccctcctcttcctcctggaagtcgcaagtactttcccctacttcccttaaactcactcgtatttctgaagaacagtaataacacttatgagcctaatacatcccttcattctattagatcttttcgtccttaccctactttttgcaacagggctttacgaagccacccccaccacttagactgtgccccaaaaaaacttgtcatccctactatcttttttctagtcatactcctattcaccgttctcaactactcatacatgccctgctcttgtttacactgccggtttacactgtttctccaagccatcacagctgatatctcctggtgctatacccaaactgccactctaaactcttgaagtaaataaataatctttgctggcaggactatgctgaatctccttaggtactctctaatcagatgtcctaggtcctcccaattcttagaccttttatacctgtttttctccttctcttattccatttagtttctcaattcatccaaaaccgtatccaggccatcgccaatcattctatacaacaaatgtttcttcttacatccccacaatatcaccccttaccacaagacctcccttcagcttaatctctcccattctaggtttccacgccaccccaatcccgcctgaagcagccctgagaaacatctcccattctctctccataccaccccccaaaaatgttcaccgccccaacacttcaacactattttgttttatttttcttattaatataagaaggcaggaatgtcacgcctctgagcccaagccaagccatcgcatcccctgtgtgacttgcacgtatacatccagatggcctgaagtaactgaagatccacaaaagaagtaaaaatagccttaactgatgacattccaccat

SEQ ID NO: 132 - DNA, 665 bp, Homo sapiens
tagactggtaagggaagaatgtctcaaatgagcatgcgtacaattccagtaaacacactgagcgtgcggcccctcccaaattctggcaggccactgcacatgcggacagcccagcccaagggcagaatcaggggagaaggaatgcaagaccctcagaagtatgccagcgtataaaatcccaagtcagaaggtcaaaccgaacacttgatctctgaagtcgcccgcttggccctcttccaagtgtacttcctttcatttctgctctaaattttttattttttatttttttatttttttttagacggagtctctctctgtcgcccaggctggagtgcagtggtgtgatctcagctggctgcaacctccacctcctgggttcaggcgattctcatgcctcagcctcccgagtagctgggactacaggtgcctgccaccacacctggctaatttttgtatttttagtagagacagggtttcgccatgttggccaggctggtctcgaactcctgacctcatgtgatctgcctgcctcggccccctaaagtgttgagattacaggcgtgaaccaccatgcccggcgtgctctaaaacttgtctcagcctttccttctgccttatgccccttagttgaattcttccttctgaggaggcaagaattgaggttg

SEQ ID NO: 133 - DNA, 5707 bp, Homo sapiens
gtcaggcctctgagcccaagccaagccatcacatcccctgtgacttgcacgtatacgcccagatggcctgaagtaactgaagaatcacaaaagaagtgaatatgccctgccccaccttaactgatgacattccaccacaaaagtgtaaatagccggtccttgccttaagtgacgacattaccttgtgaaagtccttttcctggctcatcctggctcagaaagcacccccactgagcaccttgcgacccccactcctgcccgccagagaacaaaacccctttgactgtaattttcctttaccttcccaaaacctataaaacagtgccacccttatctcccttcgctgactctctctttggactcagcccgcctgcacccaggtgaaataaacagccatgttgctcacacaaagcctgtttggtggtctcttcacgccgacgcacatgaaatttgatgccgtgacttggatctggggacctcccttgggagatcaatcccctgtactcctgttctttgctccgtgagaaagatccacctatggcctcaggtcctcagactgaccagcccaaggaacatctcatcaattttaaatcaggtaagcggcctcttcttactctcttctccagcctctctcactgtccctcaaccactttctcctttccactcttcaatctctcccttctcttaatttcaattcctttcattttctgggagagacaaaggagacacgttttatccgtggacccaaaactccggtgccggtcacggactgggaaggcagccttcccttggtgtttaatcattgcagggacacctctctgattatacacccacgtttcacgggtgtcagaccacgcagggacgcctgccttggtccttcacctttagcggcaagtcccgcttttctgagggaggggcaagtacccctcaaccccttctctttcacccttagcggcaagtcccgcttttctagggggcaagaatgtccaataccttatttccgcaccccaacctagtatctccatgccccaatcctttatttccatgccccgaccccttatttccgtgccccgaccccttatttctgcaccccatcccttatttccgtgccccgaactcttatatctgcaccccaaccccttttctcacttttctgaaaggtaagaatccctgaaccccttccctccgtttctctactctctcttttctcgaggcttgcttcctccactataggcaaacttccaccctccattcctccttctactcccttggcctgtgttctcaaaaacttaaaacctcttcaactcacacctgacctaaaacctaaatgccttattttcttctgcaatgccgcttgaccccaatacaaactcaacagtagttccaaatagccagaaaatggaactttgaatttctccatcctgcaagatctaaataattcttgtcataaaataggcaaatgatctgaggtgcctgacgtccaggcattcttttacacatcagtcccttcctagtctctgtgcccagtgcaactcatcccaaatcttctttccctcccacctgtcccctcagtcccaatcccaagcgtcgctgagtctttctaatcttccttttctacagacctatctgacctctcccctcctcgccagcccgagctaggtcccaattcttcctcagcctccgctcctccaccctataatctttttatcgcctcccctcctcacacctggtcgggcttacagtttcgttctgtgactagccctcccccacctgcccagcaatttactcttaaaaaggtggctggagccaaaggcatagtcaaggttaatgctcctttttctttatcccaaatcagaaccgtttaggctctttttcatcaaatataaaaatccagcccagttcatggatcgtttggcagcaaccctgagacactttacagccctagaccctaaaaggtcaaaaggctgtcttattctcaatatacattttattatccaatctgctccccacattaaataaaactccaaaaattaaattccggccctcaaaccccacaacaggatttaactaacctcgccttcaaggtgtacaataatagaaaaaagttgcaattccttgtccccactgtgagacaaaccccagccgcatctccagcacacaagaacttccaaacgcctgaaccgcagcggccaggtgttcctccagaacctcctcccccaggagcttgctacaagtgccagaaacgtggccaccaggccaaggaatgcctgcagcccaggattcctcctaagccacgtcccatctgtgccggaccccactggaaatcggactgtccaactcacctggcagccactcccagagcccctggaactctggcccaaggctctctgactgcttcccagatcttcttggcttagcggctgaagactgacgctgcctgattgcctcggaagccccctagaccatcacggatgcccagcttcaggtaactctcacagtggaaggtaagcccgtccccttcttaatcaatacggaggctacccactccacattaccttcttttcaagggcctttttcccttgcctccacagctgttgtcggtattgatggccaggcttctaaacctcttaaaactccccaactctggggccaacttagacaatactcttttaagcactcctttttagttatccccacctgcccagttcccttattaggctgagacactttaactaaattgtctgcttccctgactattcctggactacagctgcatctcattgctgcccttcttcccaatccaaagcctcctttgcatcctcctcttgtatcccccaaacttaacccgcaagtataaaatacctctactccctccttggtgactgatcatgcaccccttatcatctcattaaaacctaatcacccttacgccactcaaccccaatatcccatcccgcagcacgctttaaaaagattaaagcctgttatcactcgcctgctacagcacggccttttaaagcctataaactctccttacaattcccccattttacctgtcctaaaaccagacaagccttacaagttagttgaggatctgcgccttattaaccaaattgttttgcctatccacccagtggtgccaaacccatatattctcctatcctcaatacctgcctctataacccattattctgttctggatctcaaacatgctttctttactattcctttgcacccttaatcccagcctctcttcactttcacttagactgaccctgacacccatcaagctcagcaaaatacctaggctgtactgctgcaaagcttcacagacagcccccattacttcaatcaagcccaaatttcttcctcatctgttacctatctcggcataattctcataaaaacacacgtgctctccctgctgatcgtgtccgactaatctctcaaaccccagcaccttctacaaaacaacaactcctttccttcctaggcatggttagtgcggtcagaattcttacacaagagccaggaccacaccctgtagcctttctgtccaaacaacttgacctactgttttagcctagccctcatgtctgcgtgcagtggctgccgctgcattaatacttttagaggccctcaaaatcacaaactatgctcaactcactctctacagttctcataacttccaaaatctattttcttcctcatacctgatgcatatactttctgctccccggctccttcagctgtactcactctttgttgagtctccctcaattccattgttcctggcccagacttcaatccagcctcccacattattcctgataccacacctgacacccaggactgtatctctccgatccacctgacattcaccccatttccccaaatttccttctttcgtgttcctcactctgatcacacttgatttattgatggcggttccaccaggcctaatcgccacacaccagcaaaggcaggttatgctatagtacaagccactagcccacctcttagaacctctcatttcctttccatcgtggaaatctatcctcaaggaaataacttctcagtgttccatctgctattctactactactcaaggattattcaggccccctcccttccctacacatcaagctcgaggatttgcccccacccaggactggcaaattagctttactcaacatgtcctgagtcagataactaaaatacctcttagtctaggtagataatttcactggataggtagaggcctttcccacagggtctgagaaggccacctcagtcatttcttcctttctgtcagacataattcctcagtttagccttcccacctcaacacactcttataacagaccagcctttattagtcaaatcagccaagcagtttttcaggctgttagtattcagtgaaacctttatatcccttacggtcctccatcttcaagaaaagtagaatggactaaagatcttttaaaaacacacctcaccaagctcagccaccaacttaaaaaggactggacaatactttaaccactttcccttctcagaattcaggcctgtcctcggaatgctacagggtactgcccatttgagctcctgtatagacgctcctttttattaggccccagtctcattccagacaccagaccaacttagactgtgccccaaaaaacttgtcatccctattatcttctgtctagtcatactcctattcaccgttctcaactactcatacatgccctgctcttgtttacactgccggtttacagtttctccaagccatcacagctgatatctcctcgtgctatccccaaactgccactcttaactcttgaagtaaatacataatctttgctggcaggactatgctgaatctccttaggcactatctaatcagatatcctgagttgtcccaattcttagaacttttatacctgtttttctccttctgttattccatttagtttctcaattcatccaaaaccatatccaggccataaccaataattctacacaacaaatgtttcttctaacaaccccacaatatcaccccttaccacaagacctcccttcagcttaatctctcccactctaggttcccacgctgcccctaatcccgcttgaagcagccctgagaaacatcacccattctctctccatatcaccccccaaaaattttcactgccccaacacttcaacactattttgttttatttttcttattaatataagaaggcaggaatgtcaggcctctgagcccaagccaagccattgcatcccctgtgacttgcacatataagcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaaacacccccactgagcaccttgggacccccactcctgcccgccaaagaacaaaccccctttgactgtaattttcctttacctacccaaatcctataaaacagccccacccctatctcccttcgctgactctctttttggactcagcctgcctgcacccaggtgaaataaacagccatgttgctcacacaaagcctgtttggtggtctcttcacatgcacgagcatgaaa

SEQ ID NO: 134 - DNA, 3863 bp, Homo sapiens
gtcaggcctctgagctcaagctaagccatcatatcccctgtgacctgcacatatatatccagatggcctgaagcaagtgaagaatcacaaaagaagtggaaatggctggttcctgacttaactgatgacattaccttgtgaaattccttctcctggctcagctactcctccactgagcaccttgtgacccccgcccctgcccgccagagaacaacccccttttgactgtaattttcctttacctacccaaatcttataaaacggccccaccctatctccctttgctgactctcttttcggactcagcctgcctgcacccaggtgaaataaacagccttgttgctcacacaaagcctgttggtggtctcttcacacagacgcgtgtgacatttggtgccgaaacccaggacaggaggactccttcgggagaccggtcccctgtcctcaccctcactccatgaggagatccacctgtgaactggggtcgtcagaccaaacaacccaaggaacatctcaccaatttcaaatcaggtaagtggtcttttcactctcttctccagcctctctcgctacccttcaatctccctgtccttccaattccagttctttttcctctctagtagagacaaaggagacacattttatccgtggacccaaaactccggcgctggtcatggactcgggaagacagtcttcccttggtgtttaatccctgcggggacgcctgcctgattattcacccacatttcactggtgtctgatcaccacggggacacctccttggtcattcacccacattcccttggtggcaagtcaattgcggggttgcctgctttggctgctcacccacactgcagcccagggctgctcaccacccccttctccgtgtctctaccctctcttttctctgggcttgcctccttcactatgggcaaccttccaccctccattcccccttcttctcccttagcctgtgttctcagaaacttaaaacctcttcaactctcacctgacctaaaacctaagcatcttattttcttctgcaacaccgcttgggccccaatacaaactcgataatggttctaaattgccagaaaatagcacttttgatttctccattttacaagacctggatgaattttgtcaaaaaatgggcgaatgggtctgaggtgctcgacgtccaggcattcttttacacattggtccctccctagtctctgctcctaatgcgactcacccgatatccttcttctttctctcctgtctgttccttaagtctgcatcccaagctctgagtcctttgaatcctccttttctacagacccatctgacctctcccctcctccccaggctgttcctcgccaggccgagccaggtcccaattcttcctcagcctccactcccataccctataatccttctgtcccctcccctgctcacacctggtccagcttacagtttcattccgaaactagccctcccccacctgcccaataatttcctcttaaagagatggctggagctgtaggcatagtcaaggttaatgctcctttttctttatctgacctctcccaaatcagttagcgtttaggctctttttcatcaaatataaaaacccagcccagttcatggctcatttggcagcaaccctgagacactttacagccctaggccctgaaaggtcagaaggccgtcttattctcaatgtgcattttattacccaatcagctcccgacatttaaaaaaagctcaaaaaattagatcctggccctcaaaccccacaacaggacttaattcacctcgccttcaaggtgtacaataatagagaagagttacaattacttgactctgttgtgagacaaaacccagccacatctccagcacacaaaaacttcaaaatgcctaagccacagtggtcaagcattcctacaggacctcctccatcaggatcttgcttcaagtgccagaaatctggccactgggccaaggaatgcccacagcccaggattcctcccaagccatgtgccatctgtgtgggaccccactggaaatcagactggccaactcacccggcagccactcccagagcccctggaaccctggcccaaggccctctgactgactccttcccagatctccttggcttagtggctaaagactgatgctgcccaatcacctcagaagcctcgtggaccatcacagatactttggataactcttatagtggagggtaagtccgtccccttcttaattaaaatatggaggctacccactccacattactttcttttcaagggcatgtttcctttgcctccataactgttgtgggtattgatggccaggcttctaaacctcttaaaactccccaactctgatgccaacttggacaacattcttttatgcactcctttttagttatccccacctgcccagctcccttattaggttgagacactttaactaaattatctgcttccctgactattcctaggctatagccacacctcattgccgcccttttccctagttcaaagcctcctttgcatcctcctctcatatcccccccaccttaacccacaagtatgggacccctctactccctccgtggcaaccaatcacacgcccattactatcccattaaaacctaatcacccttaccctgctcaacaccaatatcccatcccacagcacactttacaaggattaaaactcattatcactcacctgttacagcatggccttttaaagcctataaactctccttaccatttcctattttacctgtccaaaaaccagacaagtcttacaagttagttcaggatccacactttatcaaccaaattgttttatctatccaccccgtggtgccaaacccacatactctcctatcctcaatacctccctccacaatccctccacaacccattattctgttctggatctcaaacatgctttctttactattcctttgcacccttcatcccagcctctcttcgctttcacttagactgaccctgacacccatcaggctcagcaaattacctgggctgtactgccgcaaggcttcatggacagcccccattacttcaatcaagcccaaatttcttcctcatcccttacctatctcggtataattcttcatgaaaacacacgtgctctccctgctgatagtgtccggctaatctcccaagccccaaccccttctacgaaacagctcctttccttcctaggcatggttaggtacttccacatttggatacctagttttaccatcctgactaaaccattatatgaactcacaaaagcaaacctagctgaccccatagatcctaaatcctttcaccactcctctttcccttccttaaaaacagccctaaaagctactctcacactagctctccctaactcatcccaacccttttcattacacacagccaaaatacagagctgtgtggtcaaaattcctacacaacagccaggaccatgccctgtactctttctgtccaaacaacttgcccttactgttttaggctggcccctacattattcctgataccacacctgacccccatgactgtatctctctgatccacctgacattcactccatttccccatatttccttcttttctgttcctcaccctgatcacacttggtttattgatggcaattccaccaggcctaatcgccactcaccagcaaaggcaggctatgctatagtatcttccacatctattattgaggctattgctcttccccgctccactatctctcagcaagccgaactcattgccttaactcaggccctcactcttgcaaaaggagtacgtgtcaatatttatactgactgtaaatatgccttc

SEQ ID NO: 135 - DNA, 5731 bp, Homo sapiens
gtcaggcctctgagcccaagccaagccatcccatcccctgtgacttgcacgtaaacgcccagatggcctgaagtaactgaataatcacaaaagaagtgaatatgccctgccccaccttaactgattacattccatcagaaaggaagtgtaaatggccggtccttgccttaagtgatgacattaccttgtgaaagtccttttcctggctcatcctggctcaaaaagcacccccactaagcaccttgcgacccccactcctgcccgccagagaacaaaccccctttgactgtaattttcctttacctacccaaatcctataaaacggccccacccctatttcccttcactgactctcttttcggactcagcccgcctgcacccaggtgaaataaacaaccatgttgctcatacagagcctgtttggtggtctcttcacatggacgcgtatgaaatttggtgccgtggctcggatcggaggacatcccttgggagatcaatcccccttcctcctgctctttgctccctgagaaggatccacctacgacctcaggtcctcagatcgaccagcccaagaaacatctcaccgatttcaaatccggtaagcggcctctttttactctcttctccaacttccctcactattccctcaacatctttctcctttcaatcttggcgctacacttcaatctctcctttctcttaatttcaattcctttcattttctggtagagacaaaagagacacgttttatccatggacccaaaactccggcaccggtcacggactgggaaggcagccttcccttggtgtttaatccttgcagggacacctctctgattatacacccacgtttcaagggtgtcagaccatgcagggacgcctgccttggtccttcacccttagcggcaagtctcgcttttctggggaaggggcaagtacctcaaccccttctctccttgtctctaccccttccccgcttttctgggagaggggcaagtacccctcaaccccttctccttcacccttagcggcaagtcctgctttcctaggcggcaagaaccccccaatcgcttatttctgcaccccaacctcttatctctgtgccccaatcccttatttctgcaccctgatctcttatctctgtgcctcaatcccttatttctgtctcccaaccccttctctgcttttctggagggcaagaaccccccaccccttctccgtgtctctactcttttctttgggcttgcctccttcactatgggtaagcttccaccttccattcctccttctcccttagcctgtgttctcaaaaacttaaaacctcttcaactcacacctgacctaaaacctaaatgccttattttcttctgcaatgccatttgaccccaatacaaactcaacagtagttccaaatagccggaaaatggcactttcaatttttccatcctacaagatctaaataattcttgtcataaaatgggcaaatggtctgaggtgcctgacgtccaggcattcttttatacatcagtcccttcctagtctctgtgcccagtgcaactcgtcccaaatcttccttctttccctcctgcctgtcctctgagtcccaaccccaagagtcactgagtctttctaatcttccttttctacagacccatctgacctctcccctccttgccagcccaagctaggtcccaattcttcctcagcctctgctcctccaccctgtaatctttttatcgcctcccctcctcacacctggtctggcttacagtttcgttctgtgactagccctcccccacctacccagcaatttactcttaaaaaggtggctggagcccgaggcatagtcaaggttaatgctcctttttctttatcccaaatcagatagcgtttaggctctttttcatcaaatataaaaacccagcccagttcatggctcgtttggcagcaatactgagacgctttacagccctagaccctaaaatgtcaaaaggccatcttattctcaatatacattttattacccaatctgctcccgacattaaataaaactccaaaaattggaatctggccctcaaacctcacaacaggacttaactaacctcaccttcaaggtgtacaataataaaaaaaagttgcaattccttgcctccactgtgagacaaaccccagccacatctccagcacacaagaacttccaaacgcgtgaactgcagcggccaggcattcctccagaacctcctcccctagaagcttgctacaagtaccagaaatctggccaccaggccaaggaatgcctgcagcccaggattcctcctaagccgtgtcccatctgtgcgggaccccactgaaaatcggactgttcaacttacctggcagccactcccagagcccctggaactctggcccaaggatctctgattgactccttcttggcttaccggctgaagactgacgctgcctgatcgcctcggaagccccgtagaccatcacggacgccgagctttaggtaactctcatggtggagggtaagtccatccccttcttaatcaatacggaggctacccactccacattaccttcttttcaagggcctgtttcccttgcctccataactgctatgggtattgacggccaggcttctaaacctcttaaaactccccaactctagtgccaacttagacaacactcttttatgcactcttttttagttatctccacctgcccagttcccttattaggctgagatattttaaccaaattatctgcttccctgactattcctagactatagccacgtctcattgatgcccttcttcccaatccaaagcctcctttgcgtcctcctcttgtattcccccaccttaacccacaagtataagatacctctactccctccttggcgaccaatcacacaccccttaccatctcattaaaacctaatcacccttacccagctcaacgccaatatcccatcccacagcaagctttgaaaggattaatgcctgctatcactcgcctgctacagcatggccttttaaagcctataaactctccttaccattcccccattttacctgtcctaaaaccagacaagccttacaagttagttcaggatctgcgccttatcaaccaaattgttttgcctatccaccccatggtgccaaacccatatactcttctatcctcaatacctgcctctacaacccattattctgttctagatctcaaacaagctttctttactattcctttgcacccttcatcccagcctctcttcgcattcacttggactgaccctgacacccatcaagctcagcaaattacctaggctgtactgccgcaaagcttcacagacagcccccattccttcaatcaagcccaaatttcttcctcatctgttacctatctcggcataattctcataaaaacacacgtgctctccctgccaagcctgtctgactgatctctcaaaccccagcaccttctacaaaacaacaactcctttccttcctaggcatggttagcgcggtcagaattcttacacaagagccaggaccacaccctgtagcctttctgtccaaacaacttgaccttactgttttagcctagccctcatgtctgcgtgcagcggctaccgctgctttaatacttttagaggccctcaaaatcagaaactatgttcaactcactctgtacggttctcataacttccaaaatctattttcttcctcatagctgacccatatactttttgcttcccggctccttcagctgtactcactctttgttgagtctcccacaattaccgttgttcccgggccagacttcaatccggcctcccatattattcctgataccacacctgacccccataactgtatctttctgatccacctgacattcaccccatttccccaaatttccttctttcctgttcctcaccctgatcacgcttgatttattgatggcggttccaccaggcctaatcgccacacaccagcaaaggcaggctatgctatagtacaagccactatcctgcctcttagaacttctcatttcctttccatcgtggaaatctatcctcaaggaaataacttctcagtgttccatctgctattctactactcctcagggattattcaggccccctcccttccctacacatcaagcttgaggatttgccccacccaggactggcaaattagctttactcaacatgccctgagtcagataactaaaatacctcttagtctaggtagatactttcactggataggtagaggcctttcctacagggtctgagaaggccaccacagtcatttcttcccttctgtcagacataattcctcagtttagccttcccacctcaatacagtgtgataacagatgagcctttattagtcaaatcagccaagcagtttttcaggctctcactcttcagtgaaacctttatagcccttacggtcctccgtcttcaagaaaagtagaatggactaaaggtcttaaaatacacctcaccaagctcagccaccaacttaaaaaggactggacaatacttttaccacttccccttctcagaattcaggcctgtcctcagaatgctacagggtacagcccatttaagctcctgtatagacgctcctttttattaggccccagtctcattccagacaccagaccaacttagactgtgctccaaaaaacttgtcatccctactatcttctgtctagtcatactcctattcaccattcctaactcctcatacatgccctgctcttgtttacactgccggtttacactgtttttccaagccatcacagctgatatctcctggtgctatccccaaactgccactcttaactcttgaagtaaataaataatctttgctggtaggactatgctgaatctccttaggcactctctaatcagatatcctgagtcgtcccaattcttagaccttttacacctgtttttctccttctgttattccatttagtttttcaattcatacaaaactatatccaggccatcaccaatcattctatacgacaaatatttcttctaacatccccacaatatcaccccttaccacaagacctcccttcagcttaatgtctcccactctaggttcccacgccgcccctaatcccacttgaagcaggcctgagaaacatggcccattctctctccataccaccccccaaaaattttcgccgccccaacacttcaacactattttgttttatttttcttattaatataagaagtcaggaatgtcaggcctctgagcccaaaccaagccatcccatcccctgtgacttgcacgtaaacgcccagatggcctgaagtaactgaataatcacaaaagaagtgaatatgccctgtcccaccttaactgatgacattccaccacaaaagaagtgtaaatggccggtccttgccttaagtgatgacattaccttgtgaaagtccttttcctggctcatcctggcccagaaaacacccccactaagcaccttgcgacccccactcctgcccgccagagaacaaaccccctttgaccgtaattttcctttacctacccaaatcctataaaatggccccatccctatttcccttcactgactctcttttcggactcagccctcctgcacccaggtgaaataaatagccatgttgctcacacaaagcctgtttggtggtctcttcacacggatgcgcatgaaa

SEQ ID NO: 136 - DNA, 104 bp, Homo sapiens
cacttggtctctcatggcacccactcggccctcttccaagtgtactttccttcctttcattactgctctaaagctttttaataaactttcaccctgatcaaaaa

SEQ ID NO: 137 - DNA, 129 bp, Homo sapiens
tacagtaggtagctagccaggcatgagcgggggaggagagggctcccccaactccaacaggaatgtcaggtgaccatcaggtgatggtcaggcagttgtcacactgcctctctaaaataataatagatg

SEQ ID NO: 138 - DNA, 336 bp, Homo sapiens
tgggtgaggaccaaagtaagcccaccccactaggaactatgttgaaaaatttcaaaaaaaggatttaagggagactatggagtactatgacaccaggaaaacttaaaactttgtgtaagatagactggccagcattagaggtgggttggccattagaaggaagcctggacaggtcccctgtttcgaaggtatggcacaaggtaacctgtaagccaaggcacccagaccagttcccgtacatagacacttgattacagctggttttagaccccccgcccccaacacacagtggttgagagaacagcagcataagcagctggcagaggcaaggaaaga

SEQ ID NO: 139 - DNA, 5913 bp, Homo sapiens
gtcaggcctctgagcccaagctaagccatcatattccctgtgacctgcacatacacatccagatggccggtttctgccttaactgatgacattccaccacaaaagaagtgaaaatgtcctgttcctgctttaactgatgacattgtcttgtgaaattccttctcctggctcatcctggctcaaaagctcccccactgagtaccttgtgacccccactcctgcccaccagagaacaacccccctttttcctttaccttcccaaatcctataaaatggccccaccccatctcccttcgctgactctctttttggactcagccaccagcacccaggtaaaataaacagccatgttgctcacacaaagcctgtttggtggtctcttcacacggtcgcgcatgaaatttggtgccgtgactcggatcggggaacctcccttgggagatcaatcccctgtcctcctgctctttgctccgtgagaaagatccacctacgacctcaggtcttcagaccaaccagcccaagaaacatctcaccaatttcaaatccagtaagtggcctctttttacttacttctccaacctccctcactatccctcaacctctttctcctttcaatcttggcgccacacttcaatctctcccttcttttaatttcaattcctttcattttctggtagagacaaaggagacacgtttcatccgtggacccaaaactccggtgccagtcacagactgggaaggcagccttcccttggtgtttaatcattgcagggacgcctctctgattattcacccacatttcagaggtgtcacactacacagggacacctgccttggtccttcacctttagcaggaagtcccacttttctgggggaggggcaagtaccccaaccccttctctccatgtctctaccccttctccgcctttctggggggcaagaaacccccaaccccttctccttcacacttagcagcaagtcccacttttctgggggaggggcaagtaccccaacctcatatctctgctccccgatcccttatttctgtgccctgacctcttacatctctgcaccccaatcccttatttccgtgccctgacctcttatctctgcgccctgatcccttatttccacgccccgacctcttatctctgtgccccaaccccttatttctgtgccctgacccctttcccgcttttctggagggtaagaacccctgaaccccttccctctgtgtctctactctcccttttctctgggcttgcctccttcactatgggcaactttccaccctccattcctccaactcccttagcctgtgctctcaagaacttaaaacctcttcaactcacacctgacctaaaacctaaatgccttattttcttctgcaatgccgcttgaccccaatacaaactcgacagtagttccaaatagccagaaaatggcactttcaagttttccatcctgcaagatctaaataattcttgttgtaaaataggcaaacggtctgaggtgcctgatgtccaggcattcttttacacatcagtcccttcctagtctctgtgcccaatgcaacttgtcccaaatcttccttctttccctccctcctgtcccctcagtcccaaccccaagcgtcactgggtctttctaatcttccttttctccagacccatctgacctctcccctcctccccaggctgcttctcgccaggtcgagctaggtcccaattcttcctcagcctccgctcctccactctataatctttttatcaccacccctcctcacacccagtctggcttacagtttcattctgcgactagccctcccccacctgcccagcaatttcctcttaaaaaggtggctggagctaaaggtatagtcaaggttaatgctcctttttctttatccgacctctcccaaatcagttagcatttagactctttttcgtcaaatataaaaatcccagcccagttcatggcttgttcggtagcaaccctgagacactttacagccctagaccctaaaaggtcaaaaggctgtcttattctcaatatacattttattacccaatctgctcctgacattaaataaaactccaaaaattaaattctggccctcaaaccctacaacaggatttaattaacctcaccttcaaggtgtacaataatagaaaaaagttgcaattccttgcctccactgtgagacaaaccccagccacatctccagcacacaagaacttccaaatgcctgaaccacagcggccaggcatttctccagaacctcctctcccaggagcttgctacaagtgccagaaatctggccactgggccaaggaatgctcacagcccagaattcctcctaagccgcgtcccatctgtgcaggaccccactggaaattggactgttcaactcacttggcaaccactcccagagcccatggaactctggcccaaggctctctgactgagtccttcccagatcttctcggcttagcagctgaagactgacactgcctgatcaccttggaagcctacaggaccatcacagatgctctaggtaactctcacagtggagggtaagtctgtccccttcttaatcaatatggaggctacccactgcacattaccttcttttcaagggcctgtttcccttgcctccataactgttgtgggtattggcggccaggcttctaaacctcttaaaaccccccaactctggtgccaacttagacaatactcttttaagcacccctttttaattatccccacctgcccagttcccttattaggctgaggcactttaactaaattatctgcttccctgactattcctggactacagccgcatctcattgctgcccttctccccaacccaaagcctccttcatgtcctcctcttgtatccccctaccttaacccacaagtataagatacctctaatccctccttggtgaccgattatgcaccccttaccatctcattaaaacctaatcacctttgccctgctcaatgccaagatcccatcccacagcacgctttgggcattaaagcctgttatcactcgcctgctacagcatggtgttttaaagcctataaactctccttacaattcccccattttacctatcctagaacaagacaagccttacaagttagttcaggatctgcgccttatcaaccaaattgttttgcctatccaccccatggtgccgaacccatatactctcctatcctcaatacctccctctacaacccattattctgttctagatctcaaacatgctttctttactattcctttgcacccttcatcccagcctctcttcgctttcacttggactgaccctgacacccatcaggctcagcaaattacctgggctgtactgctgcaaggcttcacagacatccctcattacttcagtcaagctcaaatttcttcctcatctgttacctgtctcagcgtaattcttataaaaacacacgtgctctccctgccgatcatgtctgactgatctctcaaaccccaacaccttctacatcctaggcatggttagatactttcgactttagatacctggttttgccatcctaacaaaaccattatataaactcacaaaaagaaacctagctgaccccatagatcctaaatcctttccccactcgtttttctgttccttgaagacagctttagagactgcccacaaccgagctctccctgactcatcccaacccttttcattacacacagctgaagtgcagggctgtgcagtcagaatttttacaggactgggatcgcgtcctgtagcctttttgtccaaacaacttgaccttactgttttaggctgaccatcatgtctccgtgcagtggctcctgcccccctaatactttcagaggcctttaaaataacaaactatgctcaactcactctctacagttctcataacttccaaaatctatcttcttcctcatacctgattcatatactttctgctccccagctccttcagctgtactcactctttgttaagtcccacaattatcattgttcctggcccagacttcaatctggcctcccacattattcctgataccacacctgaccctcatgactgtatctctctgatccacctgacgttcaccccatttccccacatttccttcttccctgtttctcaccctgatcacacttagtttattgatggcagctccaccaggcctaatcgccacacaccagcaaaggcaggctatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagcttgaggatttgcccccacccaggactggcaaattagctttactcaacatgccccgagtcagataactaaaatacctcttagtctaggtagacactttcactggataggtagaggcctttcctacagggtctgagaaggccaccgcagtcatttcttcccttctgtcagacataattcctcagtttagccttcccacctctctacagtctgataacagaccagcctttattagtcaaatcagccaagcagtttttcaggctcttagtattcagtgaaacctttatatcccttacggtcctccatcttcaggaaaagtagaacggagtaaaggtcttttaaaaacacacctcaccaagctcagccaccaacttaaaaaggactggacaatacttttactactttcccttctcagaagtcagacctgtcctcagaatgctacaaggtacagcccatttgagctcctgtatagacgctccgttttattaggcccagtctcattccagacaccagaccaacttagactgtgccccaaaaaacttgtcatccctactatcttctgtctagtcatactcttattcaccgttctcaactactcatacatgccctgctcttgtttacactgccggtttacaccgtttctccaagccatcacagctgatatttcctggtgctatccccaaactgccactcttaactcttgaagtaaataatctttgctggtaggactatgctgaatctccttaggcactctctaatcagatgtcctgagtcgtcccaattcttagaccttttatacctatttttctccttctctcattccatttagtttttcaattcatacaaaactgtatccaggccatcaccaataattctaaatgacaaatattccttctaacaaccccacaatatcaccccttaccacaaaatctcccttcagattaatctctcccactctaggttcccatgccacccctaatcccgctcgaagcagccctgagaaacatcgcccattatctctccataccatcccccaaaattttcgctgtccgaacactttaccactatttcattttatttttcttattaatataagaagataggaatatcaggcctctgagcccaagctaagccatcatattccctgtggcctgcacgtacacatccagatggccggttcctgccttaactgatgacattccaccacaaaagaagtgaaaatggcctgttcctgctttaactgatgacattgtcttgcgaaattcctcctcctggctcatcctggctcaaaagctcccccactgagtaccttgtgaccccctcagtcctgcctgccagagaacaacacccctttttcctttacctacccaaatcctataaaacggccccaccccatctctcttcgctgactctctttttggactcagcccgcctgcacccaggtgaaataaacagccatgttgctcacacaaagcctgtttggtggtctcttcacacggacgcgcatgaaa

SEQ ID NO: 140 - DNA, 6028 bp, Homo sapiens
gtcaggcctctgagcccaagccaagccatcgcatcccctgtgacttgcacatatacgcccagatggcctgaagtaactgaagaatcacaaaagaagagaaaaggccctgccctgccttaactgatgacattccaccattgtgatttgttcctgccccaccattaaccctgtgaatttccttctcctggctcagaagctccccaactgagcaccttgtgacccctacccctgcccaccagaaaacaaccccctttgactgtaattttccattaccttcccaaatcctataaaacggccccacccctatctcccttcgctgactctctttttggactcagcccgcctgcacccaggtgaaataaacagccatgttgctcacacaaagcctgtttggtggtctcttcacatggacgcgcatgaaatttggtgctgtgactcgaattgggggacctcccttgggagatcaatccgctgtactcctgttctttgctccgtgagaaagatccacctatgacctcaggtcctcagaccgaccagcccaaggaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtgcacccaaaactctggcgccggtcacggactgggaaggcagccttcccttggtgtttaaacattgcagggacgcctctctgattatacacccacgtttcaaaggtgtcagatcacgcagggacgcctgccttggtccttcacccttagtggcaagtcctgcttttctggggaaggggcaagtaccccaaccccttctctccttgtctctaccccttctctgcttttctgggggaggggcaagtacccctcaactccttctccttcacccttagcggcaagtcccgcttttctgggagaggggcaagtacccctcaaccccttctccttcacccttagtggcaagtcccgcttttctgggggaggggcaagtacccctcaaccccttctccttcacccttagtggcaagtcccgcttttctgggggaggggcaagtacccctcaaccccttctccttcactcttagcggcaagtcctgcttttctagaggaggggcaagtaccccaacctcgtatctctgcgccccaatcccttatttccacgcccctacctcttatctctgcgccccaatcccttatttctgtgccccgaccccttatttccatgccccaaccccttatttctgtgccccatcccttatttccgtgccccgacctcttatctctgcgccccaaccccttttcccacttttctggaaggtaagaaccgccgaaccccttctctctgtttctctactctctcttttctctaggcttgcttccttcactatgggcaaccttccaccctccattcctccttctactcccttggcctgtgttctcaaaaacttaaaacctcttcaactcacacctgacctaaaacctaaatgccttattttcttctgcaatgccacttgaccccaatacaaactcaacagtagttccaaatagccagaaaatggcactttgaatttctccatcctgcaagatctaaataattcttgtcgtaaaataggcaaatggtctgaggtgcctgacgtccaggcattcttttacacatcagtcccttcctagcctctgtgcccagtgcaactcgtcccaaatcttccttctttccctcccgcctgtcccctcagtaccaaccccaagcgtcgctgagtctttctaatcttcattttctacagacccatctgacctctcccttcctccccaggctgctcctcgccaggccgagctaggtcccaattcttcctcagcctctgcttctccaccctataatccttttatcacctcccctcctcacacctggtccggcttacagtttccttccgtgactagccctcccccacctgcccagcaatttactcttaaaaaggtggctggagctaaaggcatagtcaaggttaatgctcctttttctttatcccaaatcagatagcatttaggctctttttcatcaaatataaaaacccagcccagttcatggctcgtttggcagcaaccctgagacgctttacagccctggaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcggccaggcgttcctccagaacctcctcccacaggagcttgctacatatgctggaaatctggccactgggccaaggaatgcccgcagcccgggattcctcctaagccgcatcccatctgtgtgggaccccactgaaaatcggactgttcaactcacctggcagccactcccagagcccctggaactctggcccaaggctctctgactgactccttcccagatcttctcggcttagcggctgaagaccgacactgcccgatcacctcggaagccccctagaccatcacggacgccaagcttcaggtaactcacagtggaaggtaaggccgtccccttcttaatctatacggaggctacccactccacattaccttcttttcaagggcctgtttcccttgcctccataactgttatgggtattgacagccaggcttctaaacctcttaaaactccccaactctggtgccaacttagacaatacccttttaagcactcctttttagttatccccacctgcccagttcccttattaggctgacgctttaactaaattatctgcttccctgactattcctggactacagctatatctcattgccgcccttcttcccaatccaaagcttcctttgcgtcctcctcttgtatccccccaccttaacccacaagtataagatacctctactccctccttgcacctcttaccatctcattaaaacctaattacccttaccccactcaacgccaatatcccatcctgcagcacgctttaaaaagattaaagcctgttatcactcgcctgctacagcatggccttttaaagcctataaactctcgttacaattcccccattttacctgtcctagaaccagacaagccttacaagttagttcaggatctgcgccttatcaaccaaattgttttgcctatccaccccgtggtgccaaacccatatactctcctatcctcaatacctgcctctacaacccattattctgttctggatctcaaacatgctttctttactattcctttgcacccttcatcccagcctctctttgctttcacttggactgaccctgacacccatcaagctcagcaagttacctaggctctactgccacaaagcttcacagacagcccccattacttcaatcaagcccaaatttcttcctcatctgttacctatctcggcataattctcataaaaacacacgtgctctccctgccaatcgtgtccgactgatctctcaaaccccagcaccttctacaaaacaacaactcctttccttcctaggcatggttagcgcagtcagaattcttacataagagccaggaccacaccgtgtagcctttctgtccaaacaacttgaccttactgttttagcctagccctcatgtctgcgtgcagcggctgccgctgctttaatactgttagaggccctaaaaatcacaaactatgctcaactcactctctacatttctcatagcttccaaaatctattttcttcctcatacctgatgcatatactttctgctccccggctccttcagctgtgctcgctctttaagtcccacaatgaccattgttcctggtccggacttcaatctggcctcccacattattcctgataccacacctgacccccatgactgtatttctctgatccacctgatattcaccccatttccccatatttcattctttcctgttcctcaccctgataacgcttgatttattgacggcagttccaccaggcctaattgccacacaccagcaaaggcaggctatgctatagtacaagccactagcccgcctctcagaacctctcatttcctttccattgtggaaatctatcctcaaggaaataacttctcagtgttccatctgctattctactactcctcagggattattcaggccccctcccttccctacacatcaagctcgaggatttgtccccacccaggactggcaaattagctttactcaacatgtcccgagtcaggaaactaaaatacctcttagtctaaatagacactttcactgaataagtaaaggcctttcctacagggtctgagaaggccaccacagtcatctcttcccttctgtcagacataattcctcagtttagccttcccacctctatacagtctgataacagaccagcctttattagtcaaatcagccaagcagtttttcaggctgttagtattcagtgaaacctttatatcccttacggtcctccgtcttcaagaaaagtagaacggactaaaggtcttttaaaaacacacctcaccaagctcagctaccaacttaaaaaggactggacaatacttttaccactttcgcttctcagaattcaggcctgtcctcagaatgctacaaggtacagccaatttaagctcctgtatagacgctcctttttattaggccccagtctcattcgacaccagaccaacttagactgtgccccaaaaaaacttgtcatccctactatcttctgtctagtcatactcctattcaccgttctcaactactcatacatgccctgctcttgtttacactgccggtttacactgtttctccaagccatcatagctgatatctcctggtgctatccccaaactgccacacttaactcctgaagtaaacaaacaatcttggctggcaggactatgctgaatctccttaggcactctctaatcagatgtcctaggtcctcccaattcttagaccttttatacctgtttttctccttcttttattccatttagtttttcaattcatacaaaactgtatccaggccatcaccaatcattctataagacaaatgtttcttctaacaaccccacaatatcaccccttaccacaaaatcttccttcagcttaatctctcccactctaggttcccacgccgcccctaatcccgctcgaagcagccctgagaaacatcgtccattctctctccataccacccccaaaaattttcgccgccccaatacttcaacactattttgttttatttttcttattaatataagaaggcaggaatgtcaggcctctgagcccaagccaagccatcgcatcccctgtgacttgcacgtatacgcccagatggcctcaagtaactgaagaatcacaaaagaagtgaaaaggccctgccccgccttaactgatgacattccaccattgtcatttgttcctgccccaccttaactgagtgattaaccctgtgaatttccttctcctggctcagaagctcccccactgagcaccttgtgacccctacccctgcccaccagagaacaaccccctttgactgtaattttccattaccttcccaaatcctataaaacggccccaccccatctcccttcactgactctcttttcggactcagcccgcctgcacccaggtgaaataaacagccatgttgctcacacaaagcctgtttggtggtctcttcacatggacgcgcatgaaa

SEQ ID NO: 141 - DNA, 567 bp, Homo sapiens
tctgggaggtgtacccaacagctcattgagaacgggccatgatgacaatggcggttttgtggaatagaaaggcgggaaaggtggggaaaagattgagaaatcggggcggtttcgtggaatagaaaggcgggaaaggtggggaaaagattgagaaatcggatggttgctgtgtctgtgtagggagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctactcttaagtacccagggacacaaacactgcggaaggccgcagggtcctctgcctaggaaaaccagagacctttgttcacttgtttatctgctgaccttccctccactattgtcctatgaccctgtcaaatccccctctgcgagaaacacccaagaatgatcaataaa

SEQ ID NO: 142 - DNA, 703 bp, Homo sapiens
tacagcaggtagtcaggcagacataagcaggggcaggagagggacccccaccatcaggaatgtcagtcaaccatcaggtgatggtcaggcagttagtaaactaaatttctaaaataataattggtcacagccagcgccaggaaaaggcagtctcccagtagacagaaacatctgaaactggtgatcagcagcttctcgataagatctcaggagttgggtgagtgggctcaagcacgttcactaaaaggcaaaatggcagtttaactggtatatgaccttctatggacatttggctggtaagagaacacttcaagtaagcgtgtttacagcgtcagtaaacacatgtgctcacctcccacacactagcaggccactgcacatgtggacagctcaccccaagagaagaatcaggggagaagggacgcaagaacctggaagtttgccgacgtataaaaccccaagtcaaaggtcaaacagcacacttgtctttcaagttgcccacttggccctcttccaagtatactttcctttgtgttattcctgctctgaagctttttaataagctttcagtcctgctctaaaacttgcctctgtctccccttctgccttaggcccctcagtctaattctttcttctgagaaggcaagaactgaggtagctgcagacctatacagatttgctgttcataacatactgtggtgcc

SEQ ID NO: 143 - DNA, 659 bp, Homo sapiens
gtcaggcctccgagcccaagcctggacgtgtacatccagatggcctgaggcaactgaagaaccacaagagaagtgaaaatggccagttcctgccttaactgacgacattgcctcatgaaattccttctcctggacagtgagtctcagaagttcccccacccagcaccctgtgacccctgcccctgcccgccagagaacaaacctctttgactgcaattttctgctacccacccagatcctataaaatggctccaccccatctccctttgctgaccacctgcacccaggtgattaaaaagctttattgctggccaggtgcggtggctcacgcctgtaatcccagcacattgggaggccgagacaggcggatcacgaggtcaggagatggagaccatcctgactaacacggtgaaaccccgtctctactaaaaatacaaaaaattagccgggtgtggtggcgggcgcctgtagtcgcagctactcgggaggctgaggcaggagaatggcgtgaacccgggaggcagagcttgcagtgagccgagatcgtgccactgcactccagcctgggtgactgagccagactccgtctccaaaacaaaaaaaagctttattgctcacacaaagcctgtttgatggtctcttcacatggactcgcatga

SEQ ID NO: 144 - DNA, 627 bp, Homo sapiens
gcaaaactgctccttctaacaaccccacaatatcaccccttaccacaaaattttccttcagtttaatctctcccactctatgttcccacgccgcccctaatcctgctcaaagcagccctgagaaacatcacccattatctctctataccactcccaaaaattttcggcgccccaacacttcaccactattttgttttgtttttcttattaatataagaagacagaaatgtcaggcctctgagcccaagctaagccatcataacccctgtgacctgcatgtatacatccagatggcctggagcaactgaagaaccacaaaagatgacattccaccattctgatttgttcctgccccactctaactaatcaatcgaccttgtgacattccccacctggacaatgagtctcatgatcttcccaccctgcaccttgtgacccctgcctgcaagagataaccacctttaactgtacttttccactacctactcaaatcctataaaactgccccaccccatctcactttgctcactctcttttcagactcagcccactttcacccaagtgaaataaacagccttcttgctcacacaaagcctgttgctggtctcttcacacagactcccatga

SEQ ID NO: 145 - DNA, 3667 bp, Homo sapiens
gtcaggcctctgagcccaagccaagccatcgcatcccctgtgacttgcatgtatacgcccagatggcctgaagtaactgaagaatcacaaaagaagtgaatacgccctgcccccaccttaactgatgacattccaccacaaaagaagtgtaaatggtcggtccttgccttaagtgatgacattaccttgaagtccttttcctagctcatcctggctcaaaaagcacccccactgagcaccttgcgacccccactcctgcccaccagagaacaaaccccctttaactataattttcctttacctacccaaatcctataaaacggccccacccttatctcgcttcactgactctcttttcggactcagcccgcctgcacccaggtgaaataaacagccatgttgctcacacaaagcctgtttggtggtctcttcacacagatgcacatgaaatttggtgccgtgactcggattgggggacctcccttgggagatcaatcccctgtactcctgttctttgctccgtgagaaagatccacctatgaccctcaggtcctcagaccgactagcccaaggaacatctcaccaattttaaatcaggtaagcagcctcttcttactctcttctccaacctctctcactgtccctcaaccactttatcctttccactcttcaatctctcccttctcttaatttcaattcctttcattttctgggagagacaaaggagacacgttttatccgtggacccaaaactctggcgcgggtcacggactgggaaggcagccttcccttggtgtttaatcattgcagggacacctctctgattatacacccatgtttcaagggtgtcagaccacgcagggacgcctgccttggtccttcacccttagcggcaagtcccgcttttctggggaaggggcaagtaccccagccccttctctccatgtctctaccccttctctgcttttctgggagaggggcaagtaccctcaacccattctccttcacccttactggcaagtcccacttttctaggaggggggcaagtacccctcaaccccttctccttcacccttagcggcaagtcctgcttttctatggggcaagaaccaccaatcccttatttccatgccccaacctcttatctctgtgccccaatcccttattcctgtgccccaacctatctctgcaccccaatcccttatttccgtgccccaacctcttatatctttgtaccccaatcccttatttccacaccctgacctcttatctctgcaccccaaccccttttcccacttttctggaaggtaagaacccccaaacccttccctccatttctctactctctcttttctctaggcttgcttccttcactatgggaaccttccaccctccattcctcctcctactcccttggcctgtgttctcaaaaacttaaaacctcttcaactcacacctgacctaaaacctaaatgccttattttcttctgcaataccgcttgaccccaatacaaactcgacagtagttccaaatagccagaaaatggcactttgaatttttcaatcctgcaaaatctaaataattcttgtaaaataggcaaacggtctgaggtgcctgacgtccaggcattcttttacacatcagtcccttcctagcctctgtgcccagtgcaactcatcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctacaatctttttatcacctcccctcctcacacctggtccggcttacagtttcgttccgtgactagccctcccccacctgcccagcaatttactcttaaaaaggtggctggagccaaaggcatagtcaaggttaatgctcctttttctttatcccaaatcagaagcgtttaggctctttttcatcaaatataaaaacccagcccagttcatggctcgtttggcagcaaccctgagacactttacagccctagaccctaaaaggtcaaaaggccatcttattctcaaaatacattttattacccaatctgctcccgacattaaataaaactccaaaaattggaatctggccctcaaaccccacaacaggacttaattaacctcaccttcaaggtgtacaataactgaaaaaagttgcaattccttgcctccactgtgagacaaaccccagccacatctccagcacacaagaacttccaaacgcctgaaccgcagtggccaggcgttcctccagaacctcctcccacaggagcttgctacacatgccggaaatctggccactgggccaaggaatgcccgcagcccgggattcctcctaagccgcgtcccatctgtgcgggaccccactgaaaatcggactgttcaactcacctggcagccactcccagagcccctggaactctagcccaaggctctctgactgactccttcccagatcttctcggcttagcagctgaagactgacactgcacgatcgcctcggaagccccctagaccattcacggacgccgagcttcgcgtaactctcacagcggaaggtaagcctgtccccttcttaatcaatacggaggctacccactccacgttaccttcttttcaagggcctgtttcctttgccttcataactgttgtgggtgttgacggccaggcttctaaacctcttaaaactccccaactctggtgccaacttagacaatactcttttaagcactcctttttagttatccccacctgcccagttcccttattaggctgagacactttaaattatctgcttccctgactattcctggactacagctatatctcattgccgcccttcttcccaatccaaatcctctttgcatctgtcctcctcttgtatccccccaccttaacccacaagtataagatacctctactccctctttggcgacggatcatgcaccccttaccatctcattaaaacctaatcacccttaccccactcaacgccaatatcccatcccgcagcacgctttaaaaagattaaagcctgttatcactcgcctgctacagcatggccttttaaagcctataaactctccttacaattcccccattttacctgtcctaaaaccagacaaggcttacaagttagttcaggatctgcaccttatcaaccaaattgttttgcctatccaccctgtggtgcccaaccccatacactcttttgttctcaataccttcctccacaactcactattccgtgcctgatcttaaagatgcttttttcactattcccctgcacccctcgtcccagcctctctttgctttcacttagactgaccctgacacccattaggctcagcaaattacctaggccatactgctgcaaaccttcacagatagaccccattacttcaatcaagcccaaatttcatcctcgtctgttacctatttcagcataattctcataaaaacatacatgctttccctgctgatcatgtccgattaatctcccaaacctcaatcccttacaaaacaacaactcctttccttcctaggcatagttag

SEQ ID NO: 146 - DNA, 323 bp, Homo sapiens
ttgctcacacaaagcttgtttggtggtctcttcacacggacgtgtatgaaatttggtgccgtgaccccaacccttaagaaggttgtttgtaattctccccacccttgagaatgtactttgtgagatccacccctgcccaccagagaacaaccccctttgactgtaattttccattaccttcccaaatcctataaaatggccccaccccatctccctttgctgactcttttcggactcagcccgcctgcacccaggtgaaataaacagccatgttgctcacacaaagcctgtttggtggtctcttcacacggacgcatatgaaa

SEQ ID NO: 147 - DNA, 4364 bp, Homo sapiens
gtcaggcctctgagcccaagccaagccatcgtatcccctgtgacttgcacgtatacgcccagatggcctgaagtaactgaagaatcacaaaagaagtgaaaaagccctgccccgccttaactgatgacattccaccattgtgatttgttcctgccccaccttaactgagtgattaaccctgtgaatttccttctcctggctccgaagctcccgcactgagcaccttgtgacccccgcccctgcccaccccatctcccttcgctgactctctttttggactcagcccacctgtacccaggtgaaataaacagctttattgctcgcacaaagcctgtttggtggtctcttcacacggacgtgcatgaaatttggtgccgtgactcgaatcgggggacctcccttgggagatcaatcccccgtcctcctgctctttgctccctgagaaagatccacctacgacctcaggtcctcagaccgaccagcccgagaaacatctcaccaatttcaaatccggtaagcagcctctttttactctcttctccaacctccctcactatccctcaacctccttctcctttcaatcttggcgccacacttcaatctctcccttctcttaatttcaattcccttcattttccggtagagacaaaggagacacattttatccgtggacccaaaactctggtgccggtcacggactcaggaaggcagccttcccttggtgtttaattattgcagggacacctctctgattatttacccacgtttcaaaggtgtcagaccacgcagggatgcctgccttggtctttcgcccttagtggcaagtcccgcttttctggggaaggggcaagtaccccaaccccttctctccttgtctctaccccttctctgcttttctggggaaggggcaagtaccctaaccccttctctccttgtctctaccccttctctgctttactggggcaggggccagtacccctcaaccccttctccttcacccttagtggcaagtcccactttcctagggggcaagaaccccccaatcacttatttctgcaccccaacctcttatctctgtgccccaatcccttatttccacaccccgacctcttatctctgtgccccaattccttatttccatgccccaaccctttctctgcttttctggagggcaagaacccctcaccccttctctgtgtctctactcttttctctgggcttgcctccttcactatgggcaagcttccaccttccattcctccttcttctcccttagcctgtattcttaagaacttaaaacctcttcaactgtcacctgacctaaaatcaaagcgtcttattttcttctgcaatgccgcttgaccccaatacaaactcgacagtagttccaaatagccagaaaatggcactttcaatttttccatcctacaagatctaaataattcttgtcataaaatgggcaaatggtctgaggtgcctgacgtccaggcattcttttacacatcagtcccttcctagtctctgtgcccagtgcaactcgtcccaaatcttccttctttccctccctcctgtcccctcagtcccaaccccaagcgtcgcagagtctttctaatcttccttttctacagacccatctgacctctcccctcctcgccaggccaagctaggtcccaattcttcctcagcctctgctcctccaccctgtaatctttttatcacctcccctccacacctggtccggcttacagttttgttccgtgactagccctcccccacctgcccagcaatttactcttaaaaaggtgcctggagctaaaggcatagtcaaggttaatgctcctttctctttatcccaaatcagatagcgtttaggctctttttcatcaaatataaaaatccagcccagttcatgatttgtttggcagcaaccctgagacgctttacagccctagaccctaagaggtctaaaggccgtcttattctcaaaatgcattttattacccaatctgctcccgacattaaataaaactccaaaaattggaatctggccattaaaccccacaacaggacttaattaacctcaccttcaatgtgtacaataacagaaaaaagttgcaattccttgcctccactgtgagataaaccccagccacatctccagcacacaagaacttccaaacgcctgaaccgcagcagccaggcgttcctccagaacctcctcccccaggagcttgctacatgtgccggaaatctggccactgggccaaggaatgcccacagcccgagattcctcctaagccacgtcccatctgtgtaggaccccactgaaaagcggactgttcaactcatctggcagccactcccagagcccctggaactctggcccaaggctctctgactgactccttcccagatcttctcggcttagcggctgaagactgacgctgcctgatcgcctcggaagccccctagaccatcacggacgccgagcttcaggtgactctcacagtggaaggtaagcccatccccttcttaatacggaggctacccactccacattaccttcttttcaagggcccgtttcccttgcctccagaactgttgtgggtattgacggccaggcttctaaacctcttaaaactccccaactctggtgccaacttagacaatactcttttaagcactccttttaattatccccacctgcccggttcccttattaggctgagacactttaactaaattatctgcttccctgactattcctggactacagctatatctcattgccgcccttctccccaacccaaagcctccttcgcgtcttcctctcatatccccccaccttaacccacacatatgggacttctctactccttccctggcaaccgatcacatgtccattaccatcccattaaaacctaatcacccttaccccactcaacgccaatatcccatcccgcagcatgctttaaaaagattaaagcctgttatcactcaactgctacagcatggccttttaaagcgtataagctctccttaccattcccccattttacctgtcctaaaaccagacaagccttacaagttagttcagaatctgcgccttatcgaccaaattgttttgcctatccaccccatggtgccaaacccatatactgtccaatcctcaatacctgcctctacaacccattattctgttctagatctcaaacatgctttctttactattcctttgcacccttcatcccaacctctctttgccttcacttagactgaccctgacacccattaggctcagcaaattacctgggctgtactgccgcaaggcttcacagacagcccccattacttcagtcaagcccaaatttcatcctcatctgttagtcatactactattcatcgttctcaactactcatacatgccctgctcttgtttacactgccggtttacactgtttctccaagccatcacagctgatatctcctggtgctatccccaaactgccactctaaactcttgaagtaaataaataatctttgctggcaggactatgctgaatctccttaggcactctctaatcagatgtcctaggtcctcccaattcttagtccttttatacctgtttttctccttcccttattccatttagtttttcaattcatacaaaaccatatccaggccatcaccaatcattctatacgacaaatgtttcttctaacatccccacaatatcaccccttaccacaagatctcccttcagcttaatctcccccactctaggttcccacgctgcccctaatctcgcttgaagcagccctgagaaacatcgcccattctctctccataccaccctcaaaaattttcgctgccccaacacttcaacactattttgttttatttttcttattaatataagaaggcaggaatgtcaggcctctgagcccaagccaagccatcgtatcccctgtgacttgcacgtatacgcccagatggcctgaagtaactgaagaatcccaaaagaaatgaaaaggccctgccccgccttaactgatgacattccaccactgtgattggttcctgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaacagccccacccctatctcccttcactgactctcttttgggactcagcccacctgcacccaggtgaaataaacagctttattgctcacacaaagcctgtttggtggtctcttcacagggacgcacatgaaa

SEQ ID NO: 148 - DNA, 5781 bp, Homo sapiens
gtcaggcctctgagcccaagctaagccatcatatcccctgtgtcctgcacgtacacatctagatggccggttcctgccttaactgatgacattatcttgtgaaattccttatcctggctcttcctggctcaaaagctcccctactgagcaccttgtgacccccactcctgcctgccagagaacaacccacctttgactgtaattttcctttacctacacaaatcttataaaatggcgccacccctatcgccctttgctctcttttcagactcagcccacctgcacccaggtgattaaaaagctttattgctcacacaaagcctgttggtgggctcttcacatggacacgagtgaaatttggtgccatgactcggatcaggggacctcccttgggagatcaatcacctgtcctcctgctctttgctccatgagaaagatccacctatgacctctggtcctcagaccaaccagcccaaggaacacctcaccaattttaaatctggtaagtggcctctttttactctcttctttaacctctctcactatccctcaacctctttctcctttcaatcttggtgccacactttgatctctcccttctcttaatttcagctcctttccttttctggtagagatggcgacgcgttttgtttgtggacccaaaactccgacacccgtcatggactcgggaagacagtcttcctttgttgtttaatcatgcgaggatgcctgcctgattattcacccacgtttcagaagtgtctgaccacacggggatgcctgccttggtccttcacccttagcaacaagtaccactttaatggggggcaagaaacccccaaccccttctctccatgtctctaccccttctctgcttttctagggggcaagaaccccccaaccccttctccttcacccttagtggcaagtaccacttttctagggggcaagaacaccccaaccccttctctccatgtctctaccccttctctgcttttctgggggacaggaaccccccaccccttctctccatgtctctactctctcttttctctgggcttgcctccttcactatgggcaagcttccgccctccattcccccttcttctcccttagcctgtattcttaaaaacctaaaacctcttcaactcacacctgaccaaaaacctaagtgccttattttcttctgcaatgctgcttgaccccaatacaaacttgacagtagttccaaatagccagaaaatggcactttcaatttttccatcctacaatatctaaataattcttgtcataaaatgggcaaacagtctgagatgcctgatgtccaggcattcttttacacatcagtccctccctagtctctgttcccaatgcaactcatcccaaatcttccctctttccctcccatctgtcccctcagtcccaacctcaagcatcgcagagtctttctaatcttccttttctacagacccatctgacctctcccctccttgccaggctgagctagttcccaattcttcctcagtctctgctcctccaccctataatccttttatcaccttcactcctcacacagggtccagcttacagtttcgttgtgactagccctccccaacctgcccagcaatttcctcttaaagaggtggctggagctaaaggcatagtcaaggttaatgctcctttttctttatcccaaatcagacagcatttaggctcttctccatcaaatgtaaaaacccagcccagttcatggctcatttggcaacaaccctgagatgctttacagccctagtccctaaaaggtcaaaaggctgtcttattctcaatatacattttattacccaatcggctcctgacattaaataaaactacaaaaattaaattctggccctcaaaccccacaacaggacttaactaacctcaccttcaaggtgtacaataatggagtagacacagccaagtagtaacatatttctgagttgcaattccttgcctccattgtgagacaaaccccagccacatctccagcacacaagaacttccaaatgcctaaaccacagtggccaggcattcctccaggcctgcctccctcaggagcttgctacgagtgccagaaatctggccaccagaccaaggaatgcccgcagtccaggattcctcttaagccatgtcccatcaatgtgggaccccactgaaaatcggactgttcaactcacctggcagccactcccagagcccctggaactctggcccaaggctgtccgactgactccttcccagatctttttggcttagtggctcaactctgatgctgcccgatcacaatagaagccccctagaccatcacggatgccaagcttcaggtaactttcacagtggtaggtaagtccatccccttcttaatcaatatggagactacccactccacattactttcttttcaagggcctgtttcctttgcctccataactgttgtaggtattgacgaccaggcttctaaacctcttaaaactccccaactctggtgccaacttagacaatactctttaaagcactcctttttagttatcaccacctgtccagctcccttattaggtcgagacattttaactaaattatctgcttccctgactattcctgggctacagccacacctcattgccaccttttaccccagttcaaagcctccttcacatcctctccttgtatctccccactttaaaccacaagtataggacacctctacatcctccttagcgacccatcatgcacctcttaccatctcattaaaacctaatcacccttaccccactcaatgccaatatcccatcccacagcatgctttaaaaggattaaagcctgttatcattcgcctgttacagcatggccttttaaagcctataaactctccttacaattcccccattttacctgtccaaaaaccggacaagccttacaggttagttcaggatctgagccttatcaaccaaattgttttgcctatccaccccatggtaccaaccccatatactctcctatcctaaatacctccctccacaaacccattattttattctggatctcaaacatgctttctttactattcctttgcaccattcaccccagcctctcttcgctttcacttaactgaccctgacacccatcaggctcagcaaattacctgggctgtactgccacaaggcttcacagacagcccccattacttcagtcaagcccaaatttcttcctcatctgttacctatcactgcataattctcataaaaacacatgtgctctccctgctgatggtgtccagctaatctcccaaatcccaatcccttctacaacatagcaactcctttccttcctaggcatggttagtgtggtcagaattcttacacaagagccaggactgcaccctgtagcctttctgtccaaacaacttaacctcattgttttagcttagccctcatgtctgtgtgcagtggctgccactgccttaataattttagaggccctcaaaatcacaaactatgctcaactcactctacagttctcataacttccaaaatctattttcttcctcacacctgatgcatatactttctgccccactccactaactctcagaaagtcgaactcattgccttaactcgagcactcactcttgcaaaaggactacacatcaatatttgtactgactctaaatatgccttccatatcttgcaccaccatgctgttatataggctgaaagagatttcctcaccacctttgcatagtggcaaagtcctccatcattaatgcctctttaataaacactctactcaaggctgctttacttccaaaggaaaccgaagtcattcactgcaagggccatcaaaaggcattgctctaagcaaggcttatgctgataaagtggctagacaagcagctagcttccaacttctgtccctcacggccagtttttctccttcacatcggtcactcccacctactcccctgctgaaacttccacctatcaatctcttcctacacaaggcaaatggttcttaggccaaggaaaatatctccttccagcctcacaggcccattctattctgtcatcatttcataacctcttccatgtaggaagctgctagcctgtctcttagaacctctcatttcctttccatcctggaaatttattctcaaggaaatcacttctcagtgttccatctgctagtctactaccactcagggattgttcaggcctcctccctttcctatacatcaagctcggggatttgcccctgcctgggactggcaaattgactttactcacatgccctgagtcagaaaactaaaatctggatagacactttcactggatgggtagaggcctttcctacagggtctgagaaggccaccacagtcatttcttcccttctgtcagacataattctttggtttggccttcccacctctatacagtctgagagcagactgacctttattagtcaaatcagccaagcattttttcaggctcttggtattcagtgaaacctttatatcccttacggtctgcagtcttcaggaaaggtagaacgaactaatggtcttttaaaaacacacctcaccaagctcaaccaccaacttaaaaaggactggacaatacttttaccactttcccttctcagaattcaggcctgtcctcagaatgctacagggtacagcccattcgagctcctgtatagacactcctttttattggccccagtctcattccagacaccagaccaacttagactgtgccccaaaaaacttgtcttccctactatcttctgtctagtcacactcctattcaccgttctcaactactcatacatgccctgctcttgtttacactgccagtttacactgtttcttcaagccatcacagctgatatctcctggtgctatcctcaaactgccactcttaactcttaaagtaaataaataatctttgctggcaggactatgctgaatctccttaggcactctctaattagatgtcctgggtcctcccggttctcagacctttaatacctgtttttctccttctcttattccgtttagtttttcaattcagacaaaaccttatccaggccatcatcaataattctaaatgactaatgtttcttctaacaaccccacaatatgaccccttaccacaaaatcttccttcaccttaatctctcccactctaggttcccacgccgccccaatcccactcaaagcggccctgagaaacattgcccattatctctccataccacctgcaaaaatttttaccgtccaacactttaccatgatttcattttatttttcttattaatataagaagacaggaatgtcaggcccctgagccgaagctaagccatcatatcccctgtgacctgcacgtacacatccagatggccagttcctgccttaactgatgacattccaccacaaaagaagtgaaaatggcctgttcctgccttaactgatgacattatcttgtgaaattccttctcctggctcattctggctcaaaagctcccctactgagcaccttgtgacccccactcctgcctgtcagagaacaacccccctttgactgtaattttcctttacctactcaaatcttataaaatagccccaccccatctcccttctctgactctcttttcagactcaacccgcctgtgcccaggtgattaaaaagtgtattgctcacacaaagtctgtttggtggtctcttcacacagacgcgagtgaaa

SEQ ID NO: 149 - DNA, 130 bp, Homo sapiens
gtcaggcctctgagcccaagctaagccatcatatcccctgccacctgcacgtatacaatccagatggcctgaagcaactgaagatccacaaaagaagtgaaaatagccttaactgatgacattccaccat

SEQ ID NO: 150 - DNA, 676 bp, Homo sapiens
caacagcaacaaccttttcatgagttaaaataaaaactcatgtcggccccagccatggggctacctgacttgacaaaaccctttacactctatgtgtcagaaagagaaaaaatggcagttggagttttcacccagactgtggggccctggccaaggccagtggcctatctctcaaaataactagatggggtttccaaaggctggctcccatgtctaagtgccccggcagcaacggccctgttagcacaagaagtagataaactaacccttgggcaaaacctgaatataaaggcccccccatgctctggtaactttgatgaatatcaaaggaccccccatgctgtggtaactttgatgaataccaaaggacatcattggctaacaaatgctagattaaccaagtaccaaagcttgctatgtgaaaatccccgcataaccattgaagtttgcaacaccctaaaccatgccaccttgcccccagtatcagagagcccagttaaacataactgtgtaaaggtattggactcagtttattctagtgggcccaacctctgagaccatccttgaacatcaatagacttgtgagctgtacgtggatgggagcagctttgccaacccctgcaaagtgactctgaagaagatgacaagtcttgctccagtcactcccggaagctga

SEQ ID NO: 151 - DNA, 438 bp, Homo sapiens
gtcaggcctctgagcccaagttaagccatcatatcccctgtgacctgcatgtatacatccagatggcctgaagtaactgaagaaccacaaaagcagtgacaatagccaattcctgccttaactgatgacattccaccattgtgatttgttcctgccccacccaaactgatcaattgaccttgtgacattccttctcctggacaatgaatctcagagctctccacagagcaccttgtgacccccaccccctgcttgcaagagaaaaaccacctttaactgtaattttccactacttacccaaatcctataacactgcaccacccctatctccctttgctgactcctttttcggactcaggacacttgcacccaggtaattaaaagctttattgctcacacaaagcctgtttgctggtctcttcaaacggatgcacgtaa

SEQ ID NO: 152 - DNA, 7356 bp, Homo sapiens
gtcaggcctctgagcccaagccaagccatcacatcccctgtgacttgcacctatacgcccagatggcctgaagtaactgaagaatcacaaaagaagtgaaaaggccctgccccgccttaactgatgacattccaccactgtgatttgttcctgccccaccttaactgagtgattaaccctgtgaatttccttctcctggctcagaagctcccccactgagcaccttgtgacccccacccctgcccaccagagaaaaaccccctttgactataattttccattaccttcccaaatcctataaaacggccccacccctatctcccttcactgactctcttttcggactcagcctgcctgcacccaggtgaaataaacagccatgttgctcacacaaagcctgtttggtcgtctcttcacatggacgcgcatgaaatttggtgccgtgactcggattgggggacctcccttgggagatcaatcccctgtcctcctgctctttgctccatgagaaagatccacctacaacctcaggtcctcagactgaccagcccaagaaacatctcaacaatttcaaatccagtaagtggcctctgtttactctcttctccaacctccctcactatccctcaacttctttctcctttcaatcttggtgccacacttcaatctctcccttctcttaatttcaattcctttcattttctggtagagacaaaggagacacgttttctccgtggacccaaaactccggcgccagtcacggactgggaaggcagccttcccttggtgtttaatcattgcagggacacctctctgattattcacccacgttgcaaaggtgtcagaccacgcagggacacctgccttggtccttcacccttagcggcaagtcccgcttttctggggaaggggcaagtacctcaaccccttctctccttgtctctaccccttctctgcttttctgggggaggggcaagtacccctcaaccccttctccttcacccttagcggcaagtcccgcttttctgggggaggggcaagtacccctcaaccccttctccttcacacttagtggcaagtccctcttttctagggggcaagaacccccaatcccttatttctgcaccccgacctcttatctctgtgccccaatcccttatttctgcaccccaacctcttatctctgtgccccaattccttatttccatgccccaaccctttctctgcttttctggagggcaagaacccccaaccccttctccgtgtctctactcttttctctgggcttgcctccttcactatgggcaagcttccaccttccattcctccttcttctcccttagcctatattcttaagaacttaaaacctcttcaactctcaccttgagaggtgacagcgtgctggcagtcctcagagccctcgcttgctcttggcacctcctctgcctgggctcccactttggtggcatttgaggagcccttcagcccaccactgcactgtgggagcccctttctgggctggccaaggctggagcccactctctcagcttgcagggaggtgtggagggagaggcgcgagcaggaaccggggctgcatacggcgcttgcgggccagctggagttccgggtgggcgtgggcttggcaggccccacactcggagcagtcggccagccctgctggccccgggcaatgagggacttagcacccgggccagcagctgcggagggtgtactgggtcccccagcagtgccagcccaccagtgctgagctcgatttctcaccgagccttagctgccttcccacggggcaggcctcgggacctgcagcccgccatgcctgagccttcccctgcctccgtgggttcctgtgcagcccgagcctccccagtgagcgctgccccctgctccacggtgcccagtcccatcaaccgcccaagggctgaggagtgcgagtgcatggcgcaggactggcaggcagctccacctgcagccctagtgcgggatccactgggtgaagccagctgggctcctgagtctggtggggatgtggagagtctttatgtctagctcagggattgtaaacacaccaatcggcactctgtatctagctcaaggtttgtaaacacaccagtcagcaccctgtgtctagctctgggtctgtgagtgcaccaatccacactctctatctagctactctggtgggaccttggagaacctttatgactagctcagggattgtaaatacaccaatcggcactctgtatctagctcaaagtttgtaaacacaccaatcagcaccctgtgtttagctcaaggtttgtgagtgcaccaatggacactctgtatctagctgctctggtggggccttggagaacctgtatgtcaaaactctgtatctaactaatctgaccgggacgtggagaaccttcgtatctagctcagggattgtaaacacaccaatcaacaccctgtcaaaacaggccactcagctctaccaatcagcaggatttgggtggggccagataaaagaataaaagcaggctgcccgagccagcattggcaacccgctcgggtccccttccacactgtggaagctttgttctttcgctctttgcaataaatcttgctgctgctcactctttgggtccacactgcttttttgagctgtaacactcaccgcgaaagtctgcagcttcactcctgaagtcagcgagaccacgagcccactgggaagaacgaacaactccagacgccccgccttaagaactgtaacactcaccgcgaaggtctgcagcttcactcctgagccagcgagaccaagaacccaccaaaaggaagaaactccgaacacatccaaacatcagaaggaacaaactccagatgcgccaccttaagagctgtaacacttaccgtgagggtccgcggcttcattcttgaagtcaatgagaccaagaacccaccaattccggacacaacctgacctaaaacctaaatgccttattttcttctgcaatgccacttgaccccaatacaaactcgacagtagttccaaatagccagaaaatggcactttcaatttttccatcctacaagatctaaataattcttgtcgtaaaatgggcaaatggtctgaggtgcctgacgtccaggcattcttttacacatcagtcccttcctagtctctgtgcccagtgcaactcatcccaaatcttccttctttccctcccgcctgtcccctcagtcccaaccccaagcatcgctgagtctttctaatcttccttttctacagacccatctgacctctcccctcctcgccaggccgagctaggtcccaattcttcctcagcctctgctcctccaccctataatctttttatcacctcccctcctcacacctggtccggcttacagtttcgttccgtgactagccctccccctcccgcccagcaatttactcttaaaaaggtggctggagctaaaggcatagtcaaggttaatgctcctttttctttatcccaaatcggatagcgtttaggctttttttcatgaaatataaaaatccagcccagttcatgacttgtttggcagcaaccctgagacactttacagccctagaccctaaaaggtcaaaaggccgtcttattctcaatatacattttattacccaatctgctcccgacattaaataaaactccaaaaattaaattctggccctcaaaccccacaacaggatttaattaacctcgccttcaaggtgtacaataatagaaaaaagttgcaattccttgcctccactgtgagacaaaccccagccacatctccagcacacaagaacttccaaatgcctgaacggcagcggccaggcgttcctccagaacctcctcccacaggagcttgctacatgtgccggaaatctggccactgggccaaggaatgcccgcagcccgggattcctcctaagccacatcccatctgtgtgggaccccactgaaaatcggactgttcaactcacctggcagccacttccagagcccctggaactctggcccaaggctctctgactgactccttcccagatcttctcggcttagcggctgaagacttgacactgcccgatcgcctcggaagccccctagaccatcacagacgccgagcttcgggtaactctcacagtggaaggtaagcctgtccccttcttaatcaatacggaggctacccactccacattaccttcttttcaagggcctgttaccgttgcttccataactgttgtgggtattgacggccaggcttctaaacctcttaaaactccccaactctggtgccaacttagacaatactcttttaagcatttctttttagttatccccatctgcccagttcccttattaggccgagatattttaaccaaattatctgcttccctgactattcctggactatagcctcatctcattgcctcccttcttcccaatccaaagcctcctttgcatcctcctctcgtatcctccaccttaacccacaagtataagatacctctactccctccttggtgaccgatcacacaccccttaccatctcattaaaacctaatcacccttaccccactcaatgccaacatcccatcccacagcatgctttaaaaggattaaagcctgttatcactcgcctgctacagcatggacttctaaaacctataaactctccttaccattcccccattttacctgtcctaaaaccagacaagccttacaagttagttcagaatctgcgccttatcaaccaaattgttttgcctatccaccccgtggtgccaaacccatatactctcctatcctcaatacctccctctactacccattattctgttctggatctcaaacatgctttctttactattcctttgcaccctcaatcccagcctctctttgccttcacttagactgaccctgacacccattaggctcagcaaattacctgggctgtactgccgcaaagcttcacagacagcccccattacttcaatcaagcccaaatttcttcctcatctgttacctatctcggcataattctcataaaaacacacgtgctctccctgcctatcgtgtccaactgatctctcaaacccaagcaccttctacaaaacaacaactcttttccttcctaggcatggttagcgcggtcagaattcttacacaagagccaggaccgcaccctgtagcctttctgtccaaacaacttgaccttactgttttagcctagccctcacgtctgcgtgcagcggctgccgctgctttaatactgttagaggccctaaaaatcacaaactatgctcaactcactctctacatttctcataacttccaaaatctattttcttcctcatacctgacgcatatactttctgctccccggctccttcagctgtactcactctttaagtcccacaattaccattcttcctggcccggacttcaatctggcctctcacattattcctgataccacacctgacccccacgactgtatctctctgatccacctgatattcatcccatttccccatatttccttctttcctgttcctcgccctgatcacgcttgatttattgatggcagttccaccaggcctaatcgccacacaccagcaaaggcaggctatgctatagtacaagccactagcccacctcttagaacctctcatttcctttccattgtggaaatctatcctcaaggaaataacttctcagtgttccatctgctattctactactcctcagggattattcaggccccctcccttccctacacttcaagctcgaggatttgctcccacccaggactggcaaattagctttactcaacatgtcctgagtcaggaaactaaaatacctcttagtctaaatagacactttcactgaataagtaaaggcctttcctacagggtctgagaaggccaccacagtcatttcttccctcctctcagacataattcctcagtttagccttcccacctctatacagtctgataacagaccagcctttattagtcaaatcagccaagcagtttttcaggctcttagtattcagtgaaacctttatatccctacggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtagagcccatttaagctcctgtatagacgctcctttttattaggccccagtctcattcgacaccagaccaacttagactgtgccccaaaaaacttgtcatccctactatcttctgtctagtcatactcctattcaccattctcaactactcatacatgccctgctcttgtttacactgccagtttacactgtttctccaagccatcacagctgatatctcctggtgctgtccccaaactgccactcttaactcttgaagtaaataaataatctttgctggcaggactatgctgaatctccttaggcactctctaatcagatgtcctaggtcctcccaattcttagaccttttatacctgtttttctccttctcttattccatttagtttttcaattcatacaaaaccgtatccaggccatcaccaatcattctatacgacaaatgtttcttctaacatccccacaatatcatcccttaccacaaaatcttccttcagcttaatctctcccactctaggttcccacgctgccccaatccggcttgaagcagcccggagaaacatcgcccattctctctccataccacccccaaaaattttcgctgccccaacacttcaacactattttgttttatttttcttattaatataagaaggcaggaatgtcaggtctctgagcccaagccaagccatcgcatcccctgtgacttgcacgtatacgcccagatggcctgaagtaactgaagaatcacaaaagaagtgaaaaggccctgccccaccttaactgatgacattccaccactgtgatttgttcctgccccaccttaactgagtgattaaccctgtgaatttccttctcctggctcagaagctcccccactgagcaccttgtgacccccacccctgcccaccagagaaaaaccccctttgactataattttccattaccttcccaaatcctataaaacggccccacccctatctcccttcgctgactctcttttcggactcagcccgcctgcacccaggtgaaataaacagccatgttgctcacacaaagcctgtttggtcgtctcttcacacggacgcgcatgaaa

SEQ ID NO: 153 - DNA, 995 bp, Homo sapiens
aaggaaaggtgatgggaagaatgtggggaaaagaaagagagatcagattattactgtgtctgtgtagaaagaagtagacataagagactccattttgttctgtactaagaaaaattcttctgccttgagatgctgttaatctgtaactctacccccaaccctgttctccctgagacatgtgctgtgtccactcagggttaaatggattaagggctgtgcaggatgttcgttgttaaacaaatgcttgaaggcagcatgcttgttaagagtcatcaccactccctaatctcaagtacccagagacacaaaacactgcggaaggccacagggacctctgccgaggaaagccaggtattgtccaaggtttctccccatgtgatagtctgaaatatggcctcgtgggaagggaaacacctgactgtcccccagcctgacaccagtaaagggtctgtgctgaggagggttagtaaaagaggaaggaacgcctctttgcagttgagataagaggaaggcatctgtctcctgctcctccctgggcaatggaatgtctcggtgtaaagtccaattgtatattccatctactgagataggggaaaactgccttagggctggaggtgggacatgctggcagcaatactgctctttaaggcattgagatgtttatgtatatgcacatcaaaagcacagcacttttttctttaccttgtttatgatgcagagacatttgttcacgtgtttacctgctgatcttctctccactattatcctattgtcctgccacatccccctctctgggaaatgcccgataatgatcaataaatagtaagggaactcagaggccggtgtcagcgtgggtcctccgtatgctgaatgctggtctcctgggcccatttttctttctctatactttgcctctgcatctgtttattttccaagtctctctttccacctaatgagaaacgcccacaggtgtggaggggcaacccatcccttca

SEQ ID NO: 154 - DNA, 765 bp, Homo sapiens
ttatagtaggtagctaggcaggcatgaacaggacaggagaggactcccctccccaaccaggaatttcaggtgaccatcagatgatggtcaggcggttattaactgtctctctaaaataataactaatccaacctgcaccagggaaagacattctctcagtagataggaaaaacctgaaactagggatcagcaatttcccaataagatctcaggaggtgggcgagtgggctccagcacgcacattaagaggcaaaacggggccgggcgcggtggctcacgcctgtaatcccagcactttgggaggccgaggggggtggatcacgaggtcaagagatcgagactatcctggccaacatggtgaaaccccgtctctactaaaaatacaaaaattagctgggcgtggtggcgcacgcctgtaatcccagctactagggaggctgagacaagagaattgcttgaacctgggaggcagaggttgcagtgagccgagatcacgccactgcactccaacctgatgatagagcgagactccgtctcaaacaaacaaacaaaaagaggcaaattgttagcatttaactggcatatgacctcctagggacttttgactggtaaagcaaagaacggctgaagtgagtatatgtacaactccagtaaacacactgcgcatgctcccctcccaaataccagcaggcccctgtgcctgtggacagcccatgcccaagggaagaatcagggtgaagggacagacgcaagacaccagaagca

SEQ ID NO: 155 - DNA, 3555 bp, Homo sapiens
gtcagtcctctgagcccaagctaagccatcattatctcctgtgacctgcatgtacatatccagatggccggttcctgccttaactgatgacattatcttgtgaaattccttctccttgctcatcctggctccaaagctcccctactgagcaccttgtggcccccactcctgcctgccagagaacaacccccctttttcctttacctacccaaatcctataaaattgccccacccctatctcccttcactgactctctttttggactcagcccacctgtacccaggtgaaataaacagctttactgctcacacaaagcctgtttggtggtctcttcacatggatgcatgtgaaatttggtgccgtgactgggatcgagggacttcccttgggagatcaatcccctgtcctcctgctctttgctctgtgagaaagatccacctatgacttcaggttctcagactgaccagcccaagaaacatctcaccaatttcaaatctggtaagcggcttctttttactctcttctccaacctccctcactatccctccacctctttctcctcccaatcttggcaccacacttcaatctctcccttctcttaatttcaattcctttcattttctggtagagacaaaggggacacgttttatctgtggacccaaaactctggcaccagtcacggactagtgaaggcagcctttccttggtgtttaatcacttgcagggacacctctctgattattcaccgaggtttcagaggtgtcagaccatgcagggatgcctgccttgttccttcacccttagcagcaagacctgcttttctgggggagggacaagaacccctcaaccccttctccttcacccttagcagcatgtcccacttttctgggggagggacaggaaccccgacctcttatctctgcaccccgatcccttatttccatgccctgacctcatctctgtgtcccgatcccttatttccacaacctgacctcttatctctgcaccccaaccctttatttctgtgcccccaaccctttccctctattctggaaggcaagaaccccccaccccttctctccatgtctctactctctcttttctctaggcttgcctccttcactatgggcaagcttccgccttccattcccctttcttctcccttaccctgtgttcttcaaaacctaaaacctcttcaactcacacctgacctaaaacctaaatgccttattttcttctacaatgctacttgaccccaatacaaactcagcagtggttccaaatagccagagaatggcactttcaatttttccatcctacaagatctagatacttcttgtcataagatgggcaaatgatctgagatgcctgatgtccaggcattcttttacacattggtccctccctagtctctgttcccagtgcaactcatccgaaatcttcctcctttccctcccacctgtcccctcagtcccaaccccaagtgtcgctgagtctttctaatcttccttttctacagacccatctgacctctcccatcctggccagcctgagctaggtcccaattcttcctcagcctccacttctccaccctataatccttttatcacctcccctcctcacactgggtctggcttacagtttaattccgtgactagccctcccccacctgcccagcaatttactcttaaacaggtgcctggagctaaagacatagtcaaggttaatgctcctttttctttatcccaaatcagatagcatttagcctctttttcatcaaatataaaaatccaccccagttcatggctcgtttggcagcaaccctgagatgctttacagccctagaccttaaaacgtcaaaaggccgtcttattctcaatatacattttattacccaatctgctcccgacattaaataaaactccaaaattaaattccggccctcaaaccccacaacaggacttaattaacctcaacttcaaggtgtacaataatggagtagaggcagcctagcagcaacatatttctcagttgcaattccttgcctccactgtgagacaaagcccagccaaatctccagcacacaagaacttccaaacgcctaaagcgcagtggccaggcattcctccagaaccacctaccccaggagcttgctacaagtgccagaaatctggccaccagaccaaggaatgcctgcagcccgggattcctcctgagccatgtcccatctgtgcgagacccaactagaaatcggactgttcaactcacctggcagccactcctagagcccctggaactccagcccaaggctctctgactcattccttcccagatcttcttggcttagcagctgaagactgacactgcctgatagatcacctcggaagcctacaggaccatcacagacgctctaggtaactctcacagtggaggagaagtccatccccttcttaatcaatacggaggctaaccactccacattaccttcttttcaagggcctgtttcccttgtctccataactgttgtgagtattgacagccaggcttctaaacctcttaaaactccccaactctggtgccaacttagacaatactcttttaagcactcctttttagttgtccccacctgcccagttcccttattaggctgagacactttaactaaattatctgcttccctgactattcctggactacagccactcctcattgccacccaccttaacccacaagtagaagatacctctattccctccttggcaacctatcacgcaccccttaccatctcattaaaacctaatcactcttacccctctcaatgccaatatcccatcccacagcatgctttgaaaggattaaagcctgttatcactcacctgctacagcatggccttttaaagcctataaactctccttacaattcccccattttacctgtcctaaaaccagacaagccttacaagttagttcaagatctgtgccttatcaaccaaattgttttgcctatccaccccaaggtgccaaacacatatactctcctatcctcagttcctccctccacaacccattattctgttctgaatctcaaacatgctttctttactattcctttgcacccttcatcccagtcactcttcgctttcacttggactgaccctgacacccatcaagctcagcaaattacctgggctgtactgtcgcaaagcttcacagacagcccccattacttcagtcaagcccaaatttctcccttatctgttacctatctcagcataattctcataaaaacacacgtgctctctctgccgatcgtgtgtgactcatctctcaaaccccaaccccttctacaaaacaacaactcctttccttcctgtgcatggttggatactttcacctttagatatctggttttgccatcctaacaaaaccattatataaactcacaaaaggaaacctagctgaccccatagatcctaaatcctttccccactcctctttctgttccttgaagacagctttaaagactgcccccaccctagtcttggttccctgac

SEQ ID NO: 156 - DNA, 354 bp, Homo sapiens
ccacaaaaaaagtgaaaatagccagttcctgccttaactgatgacattccaccattgtgatttgttcctgctccaccctaactgatcaattgaccttgtgacattccttctcctggacaatgagtctcagaatctccccactgagcactttgtgacccttgcccctgcccacaagaaaaagaaaccctttaactgtaattttccattacctacccaaatcctataaaactgccccaccccatctccctttgctgacctctttttcagactcagtccgcctgcacccaggttattaaaaagctttattgctcacgcaaagcctgtttggtggtctcttcacatagacacatgtga

SEQ ID NO: 157 - DNA, 5300 bp, Homo sapiens
gtcagggcctctgagcccaagccaagccactgcatcccctgtgacttgcacatataccgcccagatggcctgaagtaactgaagaatcacaaaagaagtgaaaatgccctgccccaccttaactgatgacattccaccaaaaaagaagtgtaaatggccggtccttgacttaagtgatgacattaccttgtgaaagtcctttttctggctcatcctggctcaaaaactcccccactgagcaccttgctacccccactcctgcccgccagagaacaaaccccctctgactgtaattttcctttacctgcccaaatcttataaaatggccccacccctatctccctttgctgactctcttttcggactcagcccgcctgcacccaggtgaaataaacagccatgttgctcacacaaagcctgtttggtggtctcttcacatggacgcgcatgaaatttggtgccatgactcgggtcagggaacctcccttgggagatcaatcccctgtcctcctgctctttgctccgtgagaaagatccacctacgacctcaagtcctcagaccgaccagcccaagaaacgtctcaccaatttcaaatccggtaagtggcctctttttactctcttctccaacttccctcactacccctcaaccccttctccttcacccttagcggcaagtcccgcttttctaggggacaagaacccccaatcccttatttccacgccccgacccctttcccgcttttctggagggtaagaacacttgaaccccttccctccatgtctctatgctctcttttctctgggcttgcctccttcactatgggcaaccttccaccctccattcctccttcttgtcccttagcctgtgttcttaagaacttaaaacctcttcaactctcacctgacctaaaatctaagcgtcttattttcttctgcaatgccgcttgaccccaatacaaactcgacagtagttccaaatagccggaaaacagcactttcaatttttccatcctgcaagatctaaataattcttgtcataaaatagacaaatggtctgaggtgcctgacgtccaggcattcttttacacatcagtcccttcctagtctctgtgcccaatgcaactcatcccaaatcttccttctttacctcctgcctgtcccctcagtcccaaccccaagcatcactgagtctttctaatcttccttttctacagacccgtctgacctctcccctcctcgccaggctgagctaggtcccaattcttcctcagcctctgctcctccaccctataatccttttatcacctcccatcctcacaactggtccggcttacagttacgtttcgtgactagccctcccccacctgcccagcaatttactcttaaaaaggtggctggagctaaaggcatagtcaaggttaatgctacttttctttatcagacctctcccaaatcactgagcatttaggctttttcatcaaatatgaaaaacccagcccagttcatggctcgttcggcagcaaccctgagacgctttacagccctagaccctaaaaggtcaaaaggccatcttattctcaatatacattttattacccaatctgctcccaacattaaataaaactccaaaaattagaatctggccctcaaaccccacaacaggacttaattaacctcaccttcaaggtgtacaataatagaaaaaagttgcaattccttgcctccactgtgagacaaaccccagccacatctccagcacacaagaatttccaaacgcctgaaccgcactggccaggcgttcctccagaacctcctcccccaggagcttgctacaagtgccagaaatctggccaccaggccaaggaatgccctcagcccaggattcctcctaagccgcgtcccatctgtgtaggaccccactggaaatcggactgttcaactcacctggcagccactcccagagcccctggaactctggcccaaggctctctgactccttctcggcttagcggctgaagactgatgctgcccgatcacctcagaagccctgtagaccatcacggatgccaagctttaggtaactctcacagtggaaggtaagcccatccccttcttaatcaatatggaggctacccactccacattaccttcttttcaagggtctctttcccttgcctccataactgttgtgcgtattgacagccaggcttctaaacctcttaaaactccccaactctcgtgccaacttagacaacactcttttaagcactcctttttaattatccccacctgcccagttcccttattaggctgagacactttaactaaattatctgcttccctgactgttcctggactacagctgcatctcattgccacccttctccccaacccaaagcctcctttgtgtcctcttttatccccccgaccttaacccacaagtataagacacctctactccctccttggtgacccatcatgcaccccttaccatctcattaaaacctaatcaccctcaccctgctcaaagccaagatcccatcccacagcacgctttaaaaggattaaagcctgttatcactcgcctgctacggcatggccttttaaagcctataaactctccttacaattcccccattttacctgtcctaaaaccagacaaggcttacaagttagttcagaatctgtgccttatcaaccaaattgttttgtctatccacctcgtggtgccaaacccatatactctcctatcctcaatacctccctctactacccattattctgttctggatctcaaacatgctttctttactattcctttgcacccttcatcccagcctctctttgctttcacttagactaccctgacacccatcaagctcagcaaattacctgggctgtactgccacaaggcttcacagacagcccccattacttcagtgaggcccaaatttcatcctcatctgttacctatctcggcataattctcataaaaacacacatgctttccctgctgatcgtgtccaattaatctcccaaacctcaatcccttacaaaacaacaactcctttccttcctaggcatggttagtgcagtcagaattcttacacaagagccaggaccacaccctgtaacctttctgtccaaacaacttgaccttactgttttagcctagccctcatgtctgcgtgcagtggctgccactgctttaatacttttaaaggccctaaaaatcacaaactatactcaactcactctccacatttctcataacttccaaaatctattttcttcctcatacctgacgcatatactttctgctccccagctccttcagctgtactcactctttgttaagtcccacaattaacattgttcttggcccggacctcaatctggcctcccacattattcctgataccacacctgacccccatgactgtatctctctgatccacctgacattcaccccatttccccatatttccttctttcctgttcctcaccctgatcacgcttgatttattgatggcagttccaccaggcctaatcgccacacaccagcaaaggcaggctatgctatagtacaagccactagcccgcctcttagaacctctcattgcctttccatcatggaaatctatcctcaaggaaataacttctcagtgttccatctgctattctactactcctcagggattattcaggccccctcccttccctacacatcaagcttgaagatttgcccccatccaggactggcaaattagctttactcaacatgccccgagtcagataactaaaatacctcttagtctaagtagacactttcactagataagtagaggcctttcctacagggtctgagaaggccaccacagtcatttcttcccttctgtcagacataattcctcattttagccttcccacctctatacagtctgataacagaccagcctttattagtcaaatcagccaagcagtttttcaggctcttagtattcagtgaaacctttatatcccttacagtcctcagtcttcaggaaaagtagaacagactaatggtcttttaaaaacacacctcaccaagctcagccaccagcttaaaaaggactggacaatactttaaccactttcgcttctcagaattcaggcctgtcctcggaatgctacaaggtacagcccagttaagctcctgtatagacgctcctttttattaggccccagtctcattccagacaccagaccaacttagactgtgccccaaaaaacttgtcatccctactatcttctgtctagtcatactcctattcaccgttctcaactactcatacatgccctgctcttgtttacactgccagtttacactgtttctccaagccatcacagctgatatctcctggtgctatccccaaaccgccactctaaactcttgaggtaaataaataatctttgctggcaggactatgctgaacctccttaggcactctccaatcagatgtcctgggtcctcccaattcttagaccttttatacctgtttttctctttctcttattccatttagtttttcaattcatataaaaccgtatccaggccatcaccaatcattctacacaacaaatgtttcttctaacaaccccacaatatcaccccttaccacaaaatcttccttcagcttaatctctcccaccccaggttcccacgccgcccctaatcccgctcaaagcagccctgagaaacatcgcccattctctctctccataccaccccccaaaaatttttaccgccccaatacttcaacactattttgttttatttttcttattaatataagaaggcaggaatgtcaggcctctgagcccaagccaagccattgcatcccctgtgacttgcatgtatacgcccagatggcctgaagtaactgaagaatcacaaaagaagtgaaaatgccctgccccaccttaaatgatgacattccaccacaaaagaagtgaaaatggccggtccttgccttaagtgatgacattaccttgtgaaagtccttttcctggctcatcctggctcaaaaagctcccccactgagcaccctgcgacccccactcctgcccgccagaggacaaaccccctttgactgtaattttcctttacctgcccaaatcttataaaacggccccaccccatctcccttcgctcactctcttttcggactcagcccgcctgcacccaggtgaaacaaacagccatgttgctcacacaaatcctgtttggtggtctcttcacacggacgtacatgaaa

SEQ ID NO: 158 - DNA, 4335 bp, Homo sapiens
gtcaggtctctgagcccaagccaagccatcccatcccctgtgacttgcacgtatacgccgagatggcctgaagtaactgaagaatcacaaaagaagtgaaaggccctgccccgccttaactgatgacattccaccattgtgatttgttcctgccccaccttaactgagtgactaaccctttgaatttccttctcctggctcagaagctcccccaccgagcaccttgtgacccccgcccctgcccaccagagaacaaccccctttgactgtaattttcctttaccttcccaaatcctataaaacggccccacccttatctcccttcactgactctcttttcggactcagcccaaccgcatccaggtgaaataaacagctttattgctcacacaaagcctgtttggtggtctcttcacatggacacacatgaaatttggtgccgtgacttggatcgggggacctcccttgggagatcaatcccccgtcctcctgctctttgctccgtgagaaagatccatctacgacctcaggtcctcagaccgaccagcccaagaaacatctcaccaatttcaaatccggtaagcggcctctttttactctcttctccaacttccttcactatccctcaacctctttctcctttcaatcttgacaccacacttcaatctctcccttctcttaatttcaattcctttcattttcggatagagacaaaggagacatgttttatccgtggacccaaaactccggtgccggtcacggactgggaaggcagccttcccttggtgtttaatcattgcagggatgcctctctgattattcacccacatttcaaaggtgtcagaccacgcagggatgcctgccttggtccttcacccttagccgcaagtcccgcttttctgggggaggggcaagtaccccaaccccttctctccatgtctctaccccttctctgcttttctgggggaggggcaagtacccctcaaccccttctccttcacccttagtggcaagtcccgcttttctagggggcaagaacccccaatcccttatttccgtgccccaaccctttctctgcttttctggagggcaagaaacccccatcacttctccgtgtctctactcttttctctgggcttgcctccttcactatggactagcttccaccttccattcctccttcttctcccttagcctgtattcttaagaacttaaaacctcttcaactctcacctgacctaaaatctaagcgtcttttttcttctgcaatgccgcttgaccccagtacaaactcgacagtagttacaaattgccagaaaaacggcactttcaatttttccatcctacaagacctaaataattcttgtcgtaaaacgggcaaatggtctgaggtgcctgatgtccaggcattcttttacacatcagtcccttcctagtctctgcccaatgcaattcatcccaaatcttccttctttccctcccgcctgtcccctcaggcccaaccccaagcgtcgctgagtctttctaatcttccttttctacagacccatctgacctctcccctcctcgccaggccgagctagttcccaattcttcctcagcctctgctcctccaccctataaactttttatcgcctcccctcctcacacctgatccggcttacagttttgttccatgactacccctcccccacctgcccagcaatttactcttaaaaaggtggctggagccaaaggcatagtcaaggttaatgctcctttttctttatcccaaatcagaagcgtttaggctctttttcatcaaatataaaaacccagcccagttcatggctcattcggcagcaaccctgagatgctttacagccctagaccctaaaaggtcaaaaggccatcttattctcaatatacattttattacccaatctgctcctgacattaaataaaactccaaaaattggaatctggccctcaaaccccataacaggacttaattaacctcactttcaaggtgtacagtaataaaacaaagttgcaattccttgcctccactgtgagacaaaccccagccacatctccagcacacaagaacttccaaacgcctgaacctcagtggccaggcattcctccagaacctcctcccccaggagcttgctacaagtgccagaaatctgaccaccaggccaagtaatgcccgcagcccaggattcctcctaagccgtgtcccatctgtgtgggaccccagtggaaatcggactgttcaactcacctggcagccactcccagagcccctggaactctggcccaaggctctctgactgactccttcttggcgtagcggctgaagactgatgctgcctgatcacctcagaagccccatagaccatcacggacgccgagctttaggtaactctcacagtggagggtaagtccgtccccttcttaatcaatatggaggctacccactccacattaccttcttttcaagggcctgtttcccttgcctccataactgttgtgggtattgacagccaggcttctaaacctcttaaaactccccaactctggtgccaacttagacaatactcttttatgcactcttttttagttatccccacctgcccagttcccttattaggccgagatattttaaccaaattatctgcttccctgactattcctggactacagccgcatctcattgctgcccttcttcccaatccaaagcctcctttgcatcctcttcttgtattcccccaccttaacccacaagtataagatacctctactccctccttggtgaccgatcatgcaccccttatcatctcattaaaacctaatcacccttaccccgctcagtgccaatatcccattacagcatgctttgaaaggattaaagcctgttatcactcgcctgctacagcatggccttttaaagcctataaactctccttacaattcccccattttacctgtcctaaaaccagacaagccttacaagttagctcaggatctatgccttatcaaccaaattattttgcctatccacctcatggtaccaaacccatatactctactatcctcaatacctccctccacaatccattattctgttctggatctcaaacatgctttctttactattcttttgcaccagtcatccaagcctctcttcgctttcacttggactgaccctgacacccatcaggctcagcaaattacctgggctgcactgccacaaggcttcacagacagaccccattacttcagtcaagcgcaaatttcatcctcatctgttacctatctcggcataattctcgtaaaaacacacatgctctccctgatgatcgtgtccgattaatctcccaaacctcaatcccttacaaaacaacaactcctttccttcctaggcatggttaatgtggtcagaattcttacacaagagccaggaccgcaccctgtagcctttctgtccaaacaacttgaccttactgttttagcctagccctcatgtccgcgtgcagcggctgccgctgctttagtacttttagaggccctcaaaatcacaaactatgctcaactcactctctacatttctcataacttccaaaatctattttcttcctcatacctgacgcatatactttctgctccctggctccttcagctgtactcactctttgttaagtcccacaattaccattgttcctggcccggacttcaatccagcctcccacattattccagacaccacacctgaccctcatgactgcatctctctgatccacctgatgttcatcccatttccccacatttccttcgtccctgtttctcaccctgatcacgcttgatttattgatggcagttccaccaggcctaatcaccacacaccagcaaaggcaggctatgctatagtacaagccactagcccgcctcttagaacctttcatttcctttccatcgtagaaatctatcctcaaggaaataacttcttagtgttccatctgctattccatctgctactcctcaaggattattcaggccccttccctacacaacaagctcgaggatttgcccccacccaggactggcaaattagctttactcaacataccccgagtcccaaaaactaaaatacctctttgtctaagtagacactttcactagataggtagaggcctttcctatagggtctgagaaggccactgcagtcatttcttcccttctgtcagacataattcctcagtttagccttcccacctctatacagtctgataaaagaccagcccttattagtcaaatcagtcaagcatttttttaggctcttagtatccagtg

SEQ ID NO: 159 - DNA, 784 bp, Homo sapiens
aaccaagcaaataatcacgctgaacccccttgggcactgtctaattggatgtcctaggtcctcccaattcttagtccttaaatacctgtttttctcctcttatttggaccttgtgtcttccgtttagtttctcaattcatacaaaactgcatccaggccatcaccaatcattctatacgacaaatgctccttctaacaaccccacaatatcaccccttaccgcaaaatcttccttcagcttaatctctaggttcccatgctgcccctaatcccactcaaagcagccctgagaaacatcgcccattatctctccataccacccccaaaaattttcgccgccccaacacttcatcactattttgttttacttttcctattaatataagaagacaggaatgtcaaggtctctgagcccaagctaagccatgatatcccctgtgacctgcacttatacatccagatggcctgaagcaactgaagaatcacaaaagaagtgaaaatggcccggttcctgccttaactgatgacactgtcttgtgaaattccttctcctggacaatgagtctcagaagttccccacggaggagcacattgtgagcccccgccctgcccaccagagaacaacccctttaactgtaattttccactacctacccaaattccataaaactgccccacccctatctccgtctgctgactctcttttcggactcagccggcctgcacccaggtgattaaaaagttttattgctcacacaaagcctgtttggtggtctcttcacac

SEQ ID NO: 160 - DNA, 688 bp, Homo sapiens
ttatagtaggtagctagtcaggcatgagcagggcaggagagggttccacctgaccaggaatgtcaggtgaccatcaggtgatggacaggaggttgttaaatgtttctctaaaatagtaattggtcacagccagtgaaagggaaaggcagtctccatatagatagaaaaaaacctgcaactggtgatcagcagcttcccaataagatctgaagagatgggtgagtgagctcaagcatgcacattaagaggcaaaatggtggagtttaactggtatatgaccttcctctaggaatgctagactggtaagggaagaatgcctcaagtgagtatgggcacaactccagtaagcacactgcacaggctcctctcccaagcgctagcaggccactgcgcatgtgaacagcccaccccaagggaagaatcaggggagaagggacacaagaccctggacgtaccaatgtataaaacctcaagtcaaaaggccaaactgcacaataaccgttcgagtcaccagcttggccctcttccaggtgcgcgttccttccttctgttcctgctctaaaactttttaataaattttcactcctctaaaacttctcggtctccctaccttatgcccctcggccgaattctttcttctgaggaggtaagaattgaggttgctgcagatgcatcagattcgctactg

SEQ ID NO: 161 - DNA, 1441 bp, Homo sapiens
acaatagtccagcttttattagtcaaatcacccaagccgtctctcaggctctcggtattcagtggaaccttcataccccttaccgtcttcaatcttcaggaaaggtagaatggactaatgatcttttaaagacacacctcaccaagctcagcctccaacttaaagaggactggacagtacttttacttcttgcccttctcagaattagcgcctgtccttgagatgctacagggtacagcccttttgaacttttatatggatgtgctttcttgcttggccccaaccttgttccagacaccagccctctgggcaactatcttccagtcctccagcaggctagacagaaaattcaccaggctgctaatcttctcacaaccttccgtagcttctctaataacttctctgctagcatcgcagacatatcacaaactttattaatccttcaggcccaggttgactctttagctgcggttgtcctccaaaaccgccaaggccttgacttactcactgctaaaaaaggaggactctgtatatttttaaatgaagagtgttgtttttacctaaatcaatctggcctagtatatgacaacataaaaaaactcaaggatagagcccaaaaacttgccatccaagtaaataattatgctgaacccccttgggcactctctaattggatgtcctgggtcctcccaattcttagccctttaatacctgtttttctccttctcttatttgtaccttgtgtcttctgtttagtttctcaattcatacaaaaccacacccaggccatcaccaatcattctatacaacaaatgctccttccaacaaccccacaatatcaccccttaccccaaaatctttcttcagtttaatctctcccactctaattacccatgccaccacaatcctgctcaaagcagccctgagaaacatcgcccattatctctccataccacagccaaaattttttgctgccccaacacttctccactattttgttttgtttttccactattttgttttgttttgttttgttttgtcaggcctctgagcccaggctaagccatcatatcccctgtgacctgcaggtatacatctagatggcctgaagcaactgacgaaccacaaaagaagtgaaaataggcagttcctgccttaactgatgactttccaccattgtgatttgttcctgccccgccccaaccaatcaatcgaccttgtgacattcctcccctggacaatgagtctcatgatctcccctctgagcaccttgtgacccctgcacctgcctgcaagagaaaaccccctttaactgtaattttccactgcctacccaaatcctataaaactgccccaccccatctccctttgctgactcctttttcggactcagtctgcctcgcctgcacccaggtgattaaaaagctttattgctcacaca

SEQ ID NO: 162 - DNA, 666 bp, Homo sapiens
ttacagtaggcagctggtcagacatgagcagggcaggagagggccctcccaaccaggaatgtcaggcgaccatcagtgttggtcgggtggctgttaactgtctctctaaaataataattggtcacagccaacgccagggaaaggcagcctcccaacagacagaaaaatccttccccataagacctcaggcattgggtgagtgggctcaagcatgtgtattaaaaggcaaaattgtggagtgtaactggtctatggcctcctagggacatttgacaggtaagggaacaacgcctcaggtaagcaggcgcgcaactccagtaaacacatagcgcgtgctcctcccaagggctggcagccactgcacatgtggacagcccaccccaagggaagaatcaggggagaaggcaggccagaccccggaagcgtgccaacatataaaaccccaagtcgaaggtcaaaccacacacctgtccttcaagtcacctgcttggcccccttccaagcgtcctttccttcctttcattcctgctctaaagctttttaataaatgtcactcctgctctaaaacttgtctcggtctcttcttctgccttctgccccttggtcgaattctttcttctgaggaggtgagaattgcggctgccgcagacctgtacggatttgcca

SEQ ID NO: 163 - DNA, 323 bp, Homo sapiens
tgggtcaggcacaaagtaagcccaccccaccaggaactatgttgaaaaatttcaagaaaggatttaagggagattacggtgttactatgacaccaggaaaacttagagctttgtgtgaaatagactggccagcattagaggtaggttggccatcagaaggaagcctggacaggtcccttgtttcaaaggtatggcacaatgtaacctgtaagccagggcacccagaccagttcctgtacatagacacttggttacagctggttttagacaccccatccccgccccacagtggttgagagaacagcagcataagtggctggcag

SEQ ID NO: 164 - DNA, 479 bp, Homo sapiens
ttacagtaggtggctagtcaggcatgaatggggcaagagagggctcccccatcaccccatcagaaaagtcgggtgaccatcaggtgatggtcagacagttgtcacactgcctctaaaataataattggtcgcagccagtgccagggaaaggcagtttccctatagacaggaaaaaactgaaactggtgatcagcagcttcctgatgagatcttaggagctgggcaagtgggctcacacatgtgcactaagaggcaaaacggtggaatttaactggtatatgaccttccgcgcccattccacggcaaaagggaagaatgcctcaggtgagcatgcgtacaactccagtaaacacaccgtgcatgctcccctcccaagcactagcaggccactgtgtatgtggacaacccacaccaagagaagaatcaggggagaaggaacgcaagacccagaatcacgccaacatataaaaccccaagtc

SEQ ID NO: 165 - DNA, 809 bp, Homo sapiens
tttgcctgcaactaaccaatggaaattacttaaaatccttcaccaaacctttcacttaggcattgatagcacccatcagatggacaaattattatttgttggaccaggccttttcaaaactatcaagcagatagtcaggtcctgtgaagtgtgccaaagaaataatcccctgtatgcaggccatacatttcaatctctgtatctttaacctccttgttaagtttgtctcttccagaatcaaagctataaaactacaaatggttctccaaatggagccccagatgcagtccatgactaagatctactgcggacctctggaccggcctgctagcccagctcccacattaatgacatcaaaggcacccctcccgaggaaatctcaactgcatgacacctactacgccccaattcagcaggaagcagttagagtggtcgttggccaacctccccaacagcacttgggttttctgttgagatgggggactgagagacaggactagctggatttcctaggccaactaagaatccctaagcctagctgggaaggtgactacacccacctttaaccactaggcttgcaacttagctcacacccgaccaatcaggtagtaaagagagcttgctaaaatgctaattaggcaaaaacaggaggtaaagaaatagccagtcatctatcgcctgacagcacaaggggcgggacaatgatcaggatataaactcaggcattcaagccagcaatggctacccactttgggtcccctcccattttatgggagctctgttttcactctattaaatctttcaactac

SEQ ID NO: 166 - DNA, 704 bp, Homo sapiens
agtaggtagctagtcaggcatgagcagggcaggaaagggctacccccaccctaccccaccagaaatgtcaggtgactatcaggcagtggtctagcagttgttacactgcctctctaaaataataattggtcacagctggtgcagagaaaggcggtcccccaatagatagaaatacctgaaactggtgatcaggggcttcccaataagatctcaagagctgggcaagtgggctcaagcatgcgcattaagaagcaaaatggcagagtttaactggtatatgactttccagggacattcgactgctaagggaagaacgccacaagtgagcatgcatacaactccagtgaacaggccgtgcaggctcactttccaagtgctagcaggccactgtgcatgtggacagcccaccccaagggaaaaatcggggagaagggatgcaagaccccagaagtgtgccaacatataaaccccaagtcaaaaaatgaaactgcacacttgatgtctcaagccacccgtcagcccgtcagccctcttccaattgtactttactttcattcccgctctaaagccttctaataagctttcactcctgttctaaaacttgcctggttctcttcttctgctttacgccccctggtcaaattctttcttctgaagaggcaagaatggaagttgttgcagacccatgtggatttactgccagt

SEQ ID NO: 167 - DNA, 967 bp, Homo sapiens
gtggggaaaagcaagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcacgctcattaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccttaaagggtctgtgctgaggaggattagtaaaagaggaaggaatgcctcttgcagttgagacaagaggaaggcatctgtctcctgcccgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaaatgatgaataaatactaggggaactcagaggctggcgggatcctccatatgctgaacgctggttcctctgttccccttatttctttctctatactttgtctctgtgtctttttcttttccaaatctctcgtcccaccttaggagaaacacccacaggtgtgtaggggcaacccacccctaca

SEQ ID NO: 168 - DNA, 264 bp, Homo sapiens
tccccttaccagggaaagaggcttcccactcttgagtccacagtgcttgcacctccgcaagacaagcatatccctaggccccccagagtagacaagagaggaggtgaagactcggaagaaacccctcccttggcagctcgtttatgacccaaaacgaggatacaactggccctgagagagcagcggtatactgggatatatgaggatggtcatgtggcggagaggggtgtttttgtgtaccagcctttcacctctgccgacctt

SEQ ID NO: 169 - DNA, 5712 bp, Homo sapiens
gttaggcccctgagcccaagctaagccatcatatcccctgtgacctgcacgcacacatccagatcgccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgactcccactcctgcctgccagagaacaacccccctttttcctttacctacccaaatcatataaaacggccccacctgtctcccttggctgactctctttttggactcagcccgcctgcacccaggtgattaaaagctttattgctcacacaaagcctgtttgatggtctcttcacacggacatgcatgaaatttggtgccatgagtcggatcgggggacctcccttgggagggcaatcccctgtcctcctgttctttgctccatgagaaagatccacctacgacctcaggtcctcagaccgaccagcccaaggaacatctcaccaattttaaatcgggtaagcggcctcttcttactctcttctccaacctctctcactgtccttcaaccactttctcctttccactcttcaatctctcccttctcttaatttcaattcctttcattttctggtagagacaaaggagacacgttttatccgtggacccaaaactccggcgccggtcagggactgggaaggcagccttcccttggtgtttaatcattgcagggactgcaatgattattcacccaggtttcagaggtgtcagaccatgcagggacgcctgccttggtccttcacccttagcggcaagtcctgcttttctggggaaggggcaagtaccccaaccccttctctccgtgtctctaccccttctcctcctttctggggggcaagaaatccccaaccccttctccttcaccctgagcggcaagtcctgcttttctagaggaggggcaagtaccccaacctcgtatctctgcaccccaatcccttatttccgtgccccgacctcttatctctgcgcccaatctcttatttccgcgccccaacctcttatatctctgtgccccaatcccttatttccacaccccaacctctaatctctgtgcccccatcccttatttccgtgccccaacctcttctccgtgccccaacccctttcccgcttttctggaaggtaagaacccccaaaccccttccctccatgtctctactctctcttttctctaagcttgcttccttcactatgggcaactttccaccctccattcctccttcttctcccttagcctgtgtcctcaaaaacttaaaacctcttcaactctcacctaaattaaaatctaagcatcttattttcttctgcaatgccgcttgaccccaatacaaactcaacagtagttccaaatagccggaaaacggcactttcaatttttccatcctacaagatctaaataattcttgttgtaaaatgggcaaatggtctgaggtgcctgacatccaggcattcttttacacatcggtccctctctagtctctgttcccaatgcaactcatcccaaatcttccttctttccctcccacctgtcccctcagtcccaaccccaagcgtcgctgaggctttctaatcttccttttctacggacccatctgacctctccccacctccccaggctgctcctcgccaggcccagctaggtcccaattcttcctcagcctccgctcctccaccctataatccttttatcacctcccctcctcacacctggtctgccttacagtttcgtttcgtgactagccctcccccacctgcccagcaattgactcttaaaaaggtggctggagctaaaggcacagtcaaggttaatgctcctttttctttatcccaaatcagatagcgttttcatcaaacataaaaacccagcccagttcgtgactcctttggcagcagccctgagacgctttacagccctagaccctaaaaggtcaaaaggccgtcttattctcaatatacattttattacccaatctgctcccgacattaaataaaactccaaaaattagaatctggcactcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcggccaggcgttcctccagaacctcctcccctaggagcttgctacaagtgctagaaatctggccaccaggccaaggaatgcctgcagcccaggattcctcctaagccatgtcccatctgtgtgggaccccactggaaatcggactgtccaactcacctggcagccactcccagagcccctggaactctggcccaaggctctctgactgcttcccagatcttcttggcttagcggctgaagactgatgctgcccgactgccttggaagccccctagaccatcacagacgccgagcttcgcgtaactctcacagtggaaagtaagtccgtccccttcttaatcaatacggaggctacccactctacattaccttcttttcaagggcctgtttcccttgcctccataactgttgtgggtattgacagccaggcttctaaacctcttaaaactccccaactctggtggcaacttagacaatactcttttaagcactcattttagttatccacacctgcccagttcccttattagggcgagccactttaactaaattatctgcttccctgactattcctggattacagctacatctcattgctgcccttcttcccagtccaaagcctcctttgcgtcctcctcttatattcccccaccttaacccacaaatataagatacctctactccctccttggtgaccgatcatgcatcccttaccatctcattaaaacctaaccacctttaccccgattaatgccaatatcccatcccacagcatgctttgaaagggttaaagcctgttatcacttgcctgctacagcatggccttttaaagcctataaactctccttaccattcccccattttacctgtcctaaaaccaagcaagccttacaagttagttcaggatctatgccttatcaaccaaattgttttgcctatccaccccatggtgccaaacccatatactctcctatcctcaatacctccctccacaatccattattctgttttggatctcaaacatgctttctttactattcctttgaacccgtcatcccagcctctctttgctttcacttggactgaccctgacacccattaggctcagcaaattacctgggctgtactgccgcaaggcttcacagacagcccccattacttcagtcaagcccaaatttcatcctcatctgttacctatctcagcataattctcataaaaacacacgtgctttccctgctgatcgtgtccgattaatctcccaaacctcaatcccttacaaaacaacaacgcctttccttcctaggcatggttagtgcggtcagaattcttacacaagagccaggaccgcaccctgtagccttcctatgcaaacaacttgaccttactgttttagcctagccctcatgtctccatgcagcggctgctgccgccctaatacttttagaggccctaaaaatcacaaactatgctcaactcactctctacatttctcataacttccaaaatctattttcttcctcacacctgacgcatatactttctgctccccggctccttcagctgtactcagtctttgttaagtcccacaattactattgttcctggcccggacttcaatccggcctcccacattattcctgataccacacctgacccccatgactgtatctctctgatccacctgacattcaccccatttccccatatttccttctttcctgttcctcaccctgatcacgcttgatttattgatggcagttccaccaggcctaatcgccacacaccagcaaaggcaggctatgctatagtacaagccactagcccgcctcttagaacctctcatttcctttctatcatggaaatctatcctcaaggaaataacttctcagtgttccatctgctattctactactcctcagggattattcaggccccttccttccctacacatcaagcttgaggatttgcccccacccaggactggcaaattagctttactcaacatgtcccaagtcaggaaactaaaatacctcttagtctaaatagacactttcactggataggtagaggcctttcctatagggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaatctttatatcccttatggtcctccgtcttcaggaaaagtagaacggactaaaggtcttttaaaaacacacctcaccaagctcagctaccaacttaaaaaggactggacaatacttttacgactttcctttctcagaagtcagacctgtcctcagaatgctacaaggtacagcccatttgagctcctgtatagacgctcctttttattaggccccagtctcattccagacaccagaccaacttagactgtgccccaaaaaaacttatcatccctattatcttctgtctagtcatactcctattcaccgttctcaactactcatacacgccctgctcttatttacactgccggtttacgctgtttctccaagccatcacagctgatatctcctggtgctatccccaaactgccactcttaactcttgaagtaaataaataatctttgctggcaggactgtgctgaatctccttaggcactctctaatcagatgtcctgagttgtcccaattcttagaccttttatacctgtttttctccttctcttattccatttagtttttcaattcatacaaaactgtatccaggccatcaccaataattctaaatgacaaatgttccttctaacaaccccacaatatcaccccttaccacaaaatcttccttcagcttaatctctcccactctaggttcccacaccgcccctaatcccgctgaagcagccctgagaaacatcgcccattatctctccataccacccccaaaaattttcgctgtcccaaaactttaccactatttagttttatttttcttattaatataagaagacaggaatgtcagccctctgagcccaagcaaagccatcatatcccctgtgacctgcacgtacacatccagatcgccggttcctgccttaactgatgacattccaccacaaaagaagtgaaaatggcctgttcctgccttaactgatgacattttcttgtgaaattccttctcctggctcatcctggctcaaaagctcccccattgagtaccttgtgacccccactcctgcccgccagagaacaacccccctttttcctttaccttcccaaatcctataaaaccgccccacccctgtctcccttggctgactttcttttcagactcagcccacctgcacccaggtgattaaaagctttattgctcacacaaagcctgtttggtggtctcttcacacggacgcgcatgaaa

SEQ ID NO: 170 - DNA, 1080 bp, Homo sapiens
tctgcaggtgtacccaacagctccgaagagacagcgaccatcgagaacgggccatgatgacgatggcggttttgtcgaaaagaaaagggggaaatgtggggaaaagcaagagagatcagattgtcactgtgtctgtgtagaaagaagtagacatgggagactccattttgttatgtactaagaaaaattcttctgccttaagattctgtgaccttacccccaaccccgtgctctctgaaacatgtgctgtgtcaaactcagggttaaatggattaagggtggtgcaagatgtgctttgttaaacagatgcttgaaggcagcatgctcgttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtatgagaggaaggcatgcctcttgcagttgagacaagaggaaggcatctatctcctgcccgttcctgggcaatggaatgtctcggtataaaacccgattgtatgttccatctactgagatagggaaaaaccgccttagggctggaggtgggacaagcaggcagcaatactgctttgtaaagcattgagatgtttatgtgtatgcatatctaaaagcacagcacttaatcctttaccttgtctatgatgcaaagaactttgttcacgtgtttgtctgctgaccctctccccacaattgtcttgtgaccctctccccacaattgtcttgtgaccctgacacatccccctcttcgagaaacacccacgaatgatcaataaatactaagggaactcagaggctggcgggatcctccatatgctaaacgctggttccccgggtccccttatttctttctctatactttgtctctgtgtctttttcttttccaagtctctcattccaccttacgagaaacacccacaggtgtggaggggcaacccaccccttca

SEQ ID NO: 171 - DNA, 666 bp, Homo sapiens
ttacagtaggtagctagtcagacatgagcagggcaggagagggtcccctgccaccaccaggatgtcgggcaaccatcaggtgataggtggttgtgacagtgccgctctaataattggtcacacctggtgccagagaaaggcagtctcccaatagatataaacacctgaaactggtgatcagcagcttcctagtaagatctcaggagttgggtgagtgggctcaagcatgggcatgaagaggcaaaacagcagagtttttagctggtatatgaccttcctctagaaacgcttgactggttagggaaaaatgcctcaagtgagcacgtgtacaactccaataaacacactgtacatgcagcccctcccaagtgctggcaggccactgcacatgctgatagcccactccaagggaggaatccggggagaaggacgcaagaccccggaagcataccaacatataaaaccccaagtcaaaggtcaaacactgcacttgatctctcaagtaacccacttggccctgttctaagtgtattttacttccttttgttccagctctaaagttttttaatcaactttcactcctgctctaaaacttgccttcgtctctcactctgctgccttatgtcccttggtcaaattctttcttctgaggaggaaagaattgag

SEQ ID NO: 172 - DNA, 406 bp, Homo sapiens
gtcaggcctccgagcccaagctaagccatcatatcccttgtgacctgcatgtatacatccagatggcctgaagtaactgaagaatcacaaaagaagtgaaaatggcctgttactgccttaactgatgacattaccttgtgaaattccttttcctggctcatcctggctcaaaagcttccccactgagcaccttgtgtcccccgcccctacctgccagagaacaaccccctttgactgaaattttcctttacctacccaaatcctataaaacagccccacccctatctgccttccctgactctgagtcccttccaggactcagcctgcctgcacccaggtgaaataaacagccttgttgctaacacaaagcctgtttggtggtctcttcacacggacaccagtgaaa

SEQ ID NO: 173 - DNA, 412 bp, Homo sapiens
gtcaggcctctgagcccaagctaagccatcatatcccctgtgacctgcacgtacacatccacatggccggttcctgccttaactgatgacatttcaccacaaaagaagtgaaaatggcctgttcctgccttaactgatgacattgtcttgtgaaattccttctcctggctcatcctggctcaaaagctcccctactgagcaccttgtgacctccagtctgcccgccagagaacaacccccctttgactgtaattttcctttatccacccaaatcctataaaatggccccacccctatctcccttcaatgactctcttttcggactcagcccacctgcatccagatgaaataaacagctttattgctcacacaaaacctgtttggtggtctcttcacacggacaagcatgaaa

SEQ ID NO: 174 - DNA, 5673 bp, Homo sapiens
gtcaggcctctgagcccaagctaagccatcatatcccctgtggcctgcacgtatatatccagatggcctgaagtaactgaagaatcacaaaagaagtgaaaatggcctgttcctgacttaactgatgacattaccttgtgaaattccttctcctggctcgtcctggctcaaaagctcccccactgagcaccttgtgtcccccacccctgcccaccagagaacaaccccctttgactgtaattttccattacctacccaaatcctataaaacggccccacccctatctcccttcgatgactgtctttttggactcagacctcctgcacccaggtgaaataaacagcctcgttgctcacacaaagcctgtttggtggtctcttcacatggacaccagtgaaatttggttccgtgactcggatcaggggacctctcttgggagatcaatcccctgtcctcctgctctttgctctgtgagaaagatccacctatgacctctggtcctcagactaaccagcccaaggaacatctcaccaattttaaatctggtaagtggcctctcttcactctcttctccaacctctctcactatccctcaacctctttcttctttcaatcttggcaccacacttcaatctctcccttctcttaatttcagttcctttccttttctcgtagagacagagatgatgcattttatctgtggacctgaagctccagcaccagtcacggacttgggtttaatcatgtggggatgcctgcctgattatttacccacatttcattggtgtctgatcaccacggggatgcttgccttggtcattcacccacattccttggtggcaagtgaattgcgggggcgcctgctttggctgctcacccacattgcagcccagggctgctcacccaaccccttctctccatgtacccaccccttctccactttcctggggggcaagcacctcccaccccttttacacttttctggggggcaagcaccccccactccttctctctgtgtctctactctctcttttctctgggcttgcctccttcattatggacaaccttccaccttccattcctccttcttctcccttagcctgcattctcaaaaacttaaaacctcttcaactctcagctgacctaaaatctaagcatcttattttcttctgcaacactgcttgaccccaatacaaactcgacagtggttccaaatagccagaaaatggcacttttgatttttccatcctacaaaatctagataattcttgtcgtaaaatgggcaaacggtctgaggtccctgatatccaggcattcttttacacattggtccctccctagtctctgttcccaatgcaactcatcccaaatcttgcttctttccctcctgcctgttctctcagtcccaaccctaatcatcactgggtctttccaatcttccttttctacagactcatctgacctgtcccctcctcaccaggctgctccttgccaggccgagctaggtcccaattcttcctcagcctctattccctgaccctataattcttttttcacctcccctcctcacacccggtctggtttacagtttcgttccacaactagccctcccccacctgcccagcaatttcctcttaaaaaggtggctggagctaaaggcgtagtcaaggttaatgttcctttttctttatctgacctctcccaaatcagttagcatttaggctctttttcatcaaatataaaaacccagcccggtccatggcccttttggcagcaaccctgagactgtttacagccctagaccctgaagggtcagaaggccatctcattctaaatatgcattttattacccagtcagctcctgacattagaataaagctccaaaaattaaattccagccctcaaaccccacaacaggacttaattaaccttgccttcaaggtgtacaataatagagtagaggcagccaagtagcaatgtatttctgaattgcaattccttgcctccactgtgagacaaaccccagacacatctccagcacacaagaactccaaatgcctgaaccgcagctgccaggggttcctccagaacctcctcccccaggagcttgctacaagtgccagcaatctggcctctgggccaaggaatgcctgcagcctgggcttcctcctagccatgtcccatctgtgcaggaccccactggaaattggactgtccaacttgccccgcagccagtcctagggcccctaaagctctagcccaaggctctctgactgactcctccccagatctgctcagcttagcagctgaagactgatgctgaccaatcacctcggaagccccctggaccatgatggacactgagctttgggtaactcttatggtggagggtaagtccgtccccttcttaatcaatacggaggctacccactccacattaccttctttccaagggcctatttcccttgcctccataactgttgtgggtattgatggcccagcttcaaaaccccttaaaattcccccactctggtgccaacttggacaacattcttttatgcactcttttttcagttatccccacctgcccagttcccttattaggccaagatattttaaccaaattatctgcttccctgactattcctggactacagccacatctcattgccgtccttcttcccaacccaaagcctcctttgcgtcttcctcttgtatcccccaaccttaacccacaaatatggaatacctctactccctccctggcaaccgatcacatgcccattactatcccattaaaatctaatcacccttaccctactcagcgccaatatctcatcctgcagcatgctttaaaaggattaaagcctgttatcactcacctgctacagcatgggcttctaaaacctataaattctgcttacaatacccccatcttacctgtcctaaaaccagacaagccttacaggttagttcaggatctgcgccttatcaaccaaattgttttgcctatccaccccgaggtgccaaacccatatactctcctatccttaatacctccctccacaacccattattctgttctagataaacctagctgaccccataaatcctaaatcctttccccactcccctttccattccttaaaaaacagccctaaaagctgctcctatgctggctctccgtaactcttcactcccttttcattacatacagctgaagtgcagggctgtgtggtcggaattcttatacaaggaccaggactgcgccctgtagcccttttatccaaacaacttgaccttactgttttagcctagccctcatgtctgtgtgtggtggctaccactgtgttaatgcttttagaggccctcaaaatcccaaactatgctcagctcactctctacagttctcataatttccaaaatctattttcttcctctcacctggctccttcagctatactcactcttagttgagtctcccacaattaccattgttcctggcctggacttcaatctggcctcccacattattcctgataccacacctgacccccatgactgtatctctctgatccacctgacattcaccccatttccccatatttccttctttcctgttcctcaccctgatcacacttggtttatcaatggcagttccaccaggcttaatcgccacacaccagcaaaggcaggctatgctatagtatcttccacatctatcattgaggctaccgctctgccccccactatctctcagcaagctgaactcattgcctgaacttgggccctcactcttgcaaagggactacaaatcaatattaatactgactctaaatatgccttccatatcctgcaccaccatatgggcagaaagaaatttctcactatgcaagggtcctccatcattaatgcctctttaaaaaaaaaacatttctcaaagctgctttacttccaaaggaagctggagtcattcactgcaaaggccatcaaaaggcaccagatcccatcgctcaggacaatgcttatgctcataaggtagctaaaaaagcagccatcaaaaggcatcagatcccatcactcaggacaatgcttatgctgataaggtagctaaaaaagcagctagcattccaacttctatccctcacggcagtttttctccttctcatctgaccactcccacctactccccactgaaacttccacatattaatcttttcccacgtaaggcaaatggttctttgaccaaggatctccttccagcctcacaggcccattctattctgtcatcatttcgtagtctcttccatgtaggttacaagccactagcccatctcttagaacctctcatttcctttccatcgtggaaatctatcctcaaggaaatcacttctcagtgttccatctgctattccactactccccaggaatttctcaggccccctcccttctctacacatcaagctcggggatttgccctgcccaggactggcaaattgactttactcacatgccccgagtcaggaaactaaaatacctcttggtctgggtagacactttcactggatgggtagaggccttttccacagggtctgagaaggccaccatggtcatttcttcccttctgtcagacataattcctcgttttggccttcccacctctatacagtctgataacggaccagcctttattagtcaaatcacccaagcagtttctcaggctcttggtattcagtggaaccttcataccccttatcatcctcaatcttcaggaaaggtaaaatggactaatggtcttttaaaaacacacctcacgaagctcagccaccaactttaaaaaaaggactctgtcaagaatagagcccaaaaactcaccaaccaaacaagtaattacactgaacccccttggacactctctaattggatgtcctgggtcctcccaattcttagtcctttaatacctatttttctccttcttttatttggaccttgtgtcttctgtttagtttctcaattcatacaaaaatgcatccaggccatcaccaatcattctatatgacaaatgcgccttctaacaaccttaccgcaaaatcttccttcagcttaatctctcccactctaggttcccacgctgcccctaattccactcgaaccagccctgagaaacatcactcatcatctctccataccaccccccaaaattttcaccaccccaaaactttaccaatattttgttttttgttatttttcttattaatataaggagacaggaatgtcaggcctctgagcccaagctaagccatcatatcccctgtgacctgcacgtatacatccagatggcctgaagtaactgaagaatcacaaaagaattgaaaatggcctgttcctgccttaactgatgatattaccttgtgaaattccttctcctggctcatcctggctgaaaagctcccccactgagcacattgtgacccccgcccctgcctgccgagaactacccactttgactgtaattttcctttacctacccacatcctataaaacggccccaccctatctcctttcactgactctcttttcggactcagcctgcctgcacccaggtgaaataaacagccttgttactcacacaaagcctgtttggtgggctcttcacacggacacgagtgaaa

SEQ ID NO: 175 - DNA, 5806 bp, Homo sapiens
gtcaggcctctgagcccaagccaagccatcgcatcccctgtgatttgcacatgtacgcccagatgacctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactgctgcctgccagagaacaacccccctttgactaattttcctttacctacccagatcctataaaatggccccacccctatctcccttcaccgactctcttttcggactcagtccgcctgcacccgggtgaaataaacagccatgttgctcacacaaagcctgtttggtggtctcttcacacggacgtgcatgaaatttggtgccgtgactcggatcgggggacctcccttgggagatcaatcccctgtcctcctgttctttgctccacgagaaagatccacctacgacctcaggtcctcagactgaccagcccaaggaacatctcaccaattttaaatcaggtaagcggcctcttcttactctcttctccaacctctctcactgtccctcaaccactttcttctttccactcttcaatctctcccttctcttaatttcaattcctttcattttctgggagagacaaaggagacatgtttttatccgtggacccaaaactccggcgctggtcacggactgggaaggcagccttcccctggtgttttatcattgcagggacgcctctctgattattcacccacgtttcaaaggtgtcagaccacgcagggacgcctgccttggtccttcacccttagcagcaagtcccacttttctgggaaaggggcaagtacctcaaccccttctctccttgtctctaccccttctctgcttttctgggggaggggcaagtacccctcaaccccttctccttcactcttagcggcaagtcccgcttttctagaggatgggcaagtaccccaacctcgtatctctgtgccccaatcccttatttccgcgccccaacctcttatatctctgtgccccaatcccttatttccatgctcgaccccttatttccgtgcccctaccccttatttctgtgcttcatcccttatttccatgccccgacctcttatctctgcgccccaacctcttttcccacttttctggaaggtaagaacccccgaaccccttccctcagtttctctactctctcttttctctaggcttgcttccttcactataggcaaccttccacccttcattcctccttctactcccttggcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaagatctaagtaattcttgtcgtaaaatagccaaatggtctgaggtgcctgacgtccaggcattcttttacacatcagtcccttcctagtctctgtgcccagtgccactcatcccaaatcttccttctttccctcccgcctgtcccctcagtaccaaccccaagcatcgctgagtctttctaatcttccttttctacagatccatctgacctctcccttcctccccaggctgctcctcgccaggccgagctaggtcccaattcttcctcagcctctgctcctccaccctataatcttttcatcacctcccctcctcacacctggtctggcttacagtttcgttccatgactagccctccccctcctgcccagcaatttactcttaaaaaggtggctggagccaaaggcatagtcaactttaatgctcctttttctttatcccaaatcagatagcgtttaggctctttttcatcaaatataaaaatccagcccagttcatgacttgtttggcagcaaccctgagacactttacagccctagaccctaaaaggtcaaaaggccgtcttattctcaaaatacattttattacccaatctgctccagacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacacaggaacttccaaatgcctgaaccgcagcggccaggctcctccagaacctcctcccacaggagcttgctacatgtgccagaaatctggccactgggccaaggaatgcctgcagcccgggattcctcctaagccgtgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagaccatcacagacgccgagcttccggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattgtctgcttccctgactattcctggactacagctatatctcattgccgcccttcttcccaatccaaagcctcctttgcgtcctcctcttgtatccccccaccttaacccacaagtataagatacctctactccctccttggcgaccaatcatgcacccgttaccatctcattaaaacctaatcacccttaccccactcaacgccaatatcccatcccgcagcatgctttaaaaagattaaagcctgttatcacttgcctgctacagcatggccttttaaagcctataaactctccttacaattcccccattttacctgtcctaaaaccggacgagccttacaagttagttcaggatctgcgccttatcaaccaaattgttttgcctatccaccccgtagtgccaaacccatatactctcctatcctcagtacctgcctctataacctattattctgttctagatctcaaacatgctttctttactattcctttgcacccttaatcccagcctctcttcactttcacttggactgaccctgacacccatcaagctcagcaagttacctaggctgtactgccgcaaagcttcacagacagcccctattacttcaatcaagcccaaatttcttcctcatctgttacctatctcagcataattctcataaaaacacacgtgctctccctgccaatcatgtccgactaatctctcaaacccaagcaccttctacaaaacaacaactcctttccttcctaggcatggttagcgtggtcagaattcttacacaagagccaggaccgcaccctgtagcctttctgtccaaacaacttgaccttactgttttagcctagccctcatgtctgcgtgcagcggctcccgctgctttaatacttttagaggccctcaaaatcacaaactatgctcaactcactctctacagttctcataacttccaaaatctattttcttcctcatacctgacgcacatactttctgctccccggctccttcagctgtacccactctttgttgagtctcccacaattaccgttgttcctggcccagacttcaatccggcctcccacgttattcctgataccacacctgacccccatgactgtatctctctgatccatctgacattcaccccatttccccaaatttccttctttcctcttcctcaccctgatcacgcttgatttattgttggcggttccaccaggcctaatcaccacacaccagcaaaggcaggttatgctatagtacaagccactagcctgcctcttagaacctctcatttcctttccatcgtggaaatcgatcctcaaggaaataacttctcagtgttccatctgctattctagtactcctcagggattattcaggcccccttccttccctacacaccaagctcaaggatttgccccacccaggactggcaaattagctttactcaacatgccctgagtcagataactaaaatacctcttagtctaggtagatactttcactggataggtagaggcctttcctacagggtctgagaaggccaccgcagtcatttcttcccttctgtcagacataattcctcagtttagccttcccacctcaatacagtctgataacagacaagcatttattagtcaaatcagccaagcagtttttcaggctcttagtattcagtgaaacctttatgtcccttatggtcctctgtcttcaagaaaagtagaatggactaaaggtcttttaaaaacacactcagccaccaacttaaaaaggactggacaatacttttaccactttcccttctcagaattcaggcctgtcctcggaatgctgcagggtacagcgcatttgagctcctgtatagacactcctttttattaggccccagtctcattccagacaccagaccaacttacactgtgccgcaaaaaacttgtcatccctactatcttctgtctagtcatactcctattcaccattctcaactactcatacatgccctgctcttgtttacactgccggtttacactgtttttccatgccatcacagctgatatctcctggtgctatccccaaactgccactcttaactcttgaagtaaataaataatctttgctggcaggactatgctgaatctccttaggcactctctaatcagatatcctgagtcgtcccaattcttagaccttttatacctgtttttctccttcctttattccatttagtttctcaattcatccaaatccatatctaggccatcaccaatcattctatatgacaaatgtttcttctaacatccccacaatatcaccccttaccacaaggcctcccttcagcttaatctctcccactctaggttcccacgtcacccctaatcccgcttgaagcagccctgagaaacatcgcccattctctctccataccaccacccaaaaatttttgccgccccaacacttcaacactattttgttttatttttcttattaatgtaagaaggcaggaatgtcaggcctctgagcccaagccaagccatggcatcccctgtgatttgcacatgtacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactgctgcctgccagagaacaacccccctttgactgtaattttcctttacctacccaaatcctataaaacggccccacccctatctcccttcactgactctcttttcggactcagtccgcctgcacccgggtgaaataaacagccatgttgctcacacaaagcctgtttggtggtctgttcacacggacgtgcatgaaa

SEQ ID NO: 176 - DNA, 6021 bp, Homo sapiens
gtcaggcctctgagcccaagccaagccatcgcatcccctgtgacttgcacgtatacacccagatggcctgaagtaactgaagaattacaaaagaagtgaatatgccctgccccgccttaactgatgacattccaccacaaaagaagaaagtgtaaatggcccgttcttgctttaactgatgacattccaccacaaaagaagtaaaaatggccggtccttgccttaagtgatgacattaccttgtgaaattccttctcctggctcatcctggctcaaaaagctcccccactgagcaccttgcaacccccactctgcccaccagagaacaacccccctttgactgtaattttcctttacctacccaaatcctataaaacagccccaccccatctcccttcactgactctcttttcggactcagcccgcctgcacccaggtgaagtaaacagccttgttgctcacacaaagcctgtttggtggtctcttcacagggacgcgcatgaaatttggtgccgtgactcagattgggggacctcccttgggagatccatcccctgtcctcctgttctttgctccgtgagaaagatccacctatgaccacaggtcctcagaccaaccagctcaagaaacatctcaccaatttcaaatccggtaagcagcctctttttactctcttcttcaacctccctcactatccctcaacctctttctcctttcaatcttggtgccacacttcaatctctcccttctctttatttcaattcctttcattttctggtggagacaaaggagacacgttttatccatggacccaaaactctggcgccagtcacgaactagggaaggcagccttcccttggtgtttaatcattgcagggacacctctctgattattcacccaggtttcagaggtgttagaccacacagggacacctgccttggtccttcacccttagcagcaagtcccgcttttctgggggagaggcaagtaccccaaccccttctctccatgtctctaccccttctccgcatgtctctaccccttctctgcatttctggggggcaagaaacccccaaccccttctccttcacccttagcagcaagtcccgcttttctggtgaaggggcaagtaccccaacctcgtatctctgtgccccgatcccttatttccatgccccgacctcctatctctgtgccccaaccccttctctgcttttctggagggcaagaaccccccaccacttctccctgtctcgtctcttctctgggctttcctccttcactatgggcaagcttccaccttccattcctccttcttctcccttagcctgtgttcttaagaacttaaaacctcttcaactctcacctgacctaaaatctaagcatcttattttcttctgcaatgccgcttgaccccaatacaaactcgacagtagttccaaataaccagaaaacagcactttcaatttttccatcctgcaagatctaaataattcttgtcgcaaaataggcaaacggtctgagatgcctgacatccaggcattcttttacacatcggtcccttcctagtctctgttcccaatgcaacttgtcccaaatcttccttctttccctcctgcctgtcccctcagtcccaaccccaatcgttgctgagtctttctaatcttccttttctacagacccatctgacctctcccttcctcgccaggccgaactaggtcccaattcttcctcagcctccgttcctccaccctataatccttttatcacctcccctcctcacacctggtgtggcttacagttttcttccgtgagtagccctcccccacctgcccagcaatttactcttaaaaaggtggctggagctaaaggcatagtcaaggttaatgctcctttttctttatcccatatcagatagcatttaggctctttttcatcaaatataaaaatccagcccagttcatggatcgtttggcagcaaccctgagatgctttacagccctagaccctgaaatgtcaaaaggccgtcttattcttaaaatacatttattaccccatctgctccctacattaaataaaacccccaaaattaaattccggccctcaaaccccacaacaggatttaattaacctcgccttcaaggtgtacaataatagaaaaaagttgcaattgcttgcttccactgtgagacaaaccccagccacatctccagcacacaagaacttccaaacgcctgaactgcagcagccaggcattcctccagaacctcctcccccaggagcttgctacaagtgccagaaatctgaccaccaagccaaggaatgcctgcagcccaggattcctcctaagccacatcccatctgtgcgggaccccaatggaaatcggactgtccaactcacctggcagccactcccagagcccctagaactctgacccaaggctctctgactccttcccagatcttcttggcttagcgactgaagactgacgctgcggatcgcctcggaagccccctagaccatcacggacgccgagcttcgggtaactctcacagtggaaggtaagtccgtccccttcttaatcaacacggaggctacccactccatattaccttcttttcaagggcctgtttcccttgcctccataactgttgtgggtattgacggccaggcttctaaacctcttaaaactccccaactctggtgccaactttgacaatactctttaaagcactccttttaattatccccacctgcccagttcccttattaggccgagacactttaactaaattatctgcttccctgactattcctggatcacagctacatctcattgctgcccttcctcccaatccaaagcctcctttgcgtcctcctgttgtatttccctaccttaacccacaattataagatacctctactgcctccttggcgaccaatcatgcaccccttaccatctcattaaaacctaatcacccttaccccactcaatgccaatatcccatcccacagcatgctttgaaaggatcaaagcctgttatcactcacctgctacagcatggccttttaagcctataaactctccttacaatttccccattttacctgtcctacaaccagacaagccttacaagttagttcaggatctaagctttatcaaccaaattgttttgcctatccaccctatggtgccaaacccatatactctcctatcctcaatacctccctccacaatccattattctgttctggatctcaaacatgctttctttactattcctttgcacccatcatcccagcctctcttcactttcacttgaactgaccctgacacccatcaggctcagcaaattacctgggctgtactgccgcaaagcttcacagacagcccccattacttcagtcaagcccaaatttcttccttatctgttacctatctcagcataattctcataaaaacacacatgctctccctgctgatcatgtctgattaatctcccaaaccccaaccgcttctacaaaacaacaactcctttccttcctgggcatagttggatacttttgcctttgaatacctggttttgccatcctaacaaaaccattatataaacttacaaaaggaaacctacatcctaacaaaaccattatataaacgcacaaaaggaaacctagctgaccccatagatcctaaatcctttccccactcctctttccattccctgaagacagctttagagactgcccccactctagctctccctgactcatcccaacccttttcattacacacagccgaagtgcagggctgtgcagtcagaattcttacacaaggaccgggatcgtgtcccctagcctttttgtccatgcaacttgaccttactgttttaggctgtccatcatgtctccgtgcagcagctgctgacaccctaatacttttagaggccctcaaaatcacaaaccatgctcaacttactctctacatttctcataacttccaaaatctattttcttcctcatacctgacgcatatactttctgctccccggctccttcagctgtactcactctttgttaagtcccacaattaccattgttcctggcccggacttcaatccggcctcccacattattcctgataccacatctgacccccatgactgtatttctctgatccacctgacattcaccccatttccccatatttccttctttcctgttcctcaccctgatctcgcttgatttattgatggtggttccaccaggcctaatcgctacacaccagcaaaggcaagctatgctatagcacaagccactagcctgcctcttagaacctctcatttcctttccatcgtggaaatctatcctcaaggaaataacttctcagtgttccatctgctattctactactcctcagggattattcaggccccctcccttccctacacatcaagctcgaggatttgcccccacccaggactggcaaattagctttactcaacatgccctgagtcagataactaaaatacctcttagtctaggtagacactttccctggataggtataggcctttcctacaaggtctgagaaggccaccgcagtcatttcttcccttctgtcagacataattcctcagtttagccttcccacctctatacagtctgataacagaccagcctttattagtcaaatcagccaagcagtttttcaggctcttagcattcagtgaaacctttatatcccttatggtcctccatcttcaggaaaaatagaacggactaaaggtcttttaaaaacacacctcaccaagctcagccaccaacttaaaaaggactggacaatacttttaccactttcccttttcggaagtcagacctgttctcagaatgctacaaggtacagcccatttgagctcctgtatagacgctcctttttattaggccccagtctcattccagacaccagaccaacttagactgtgccccccaaaaaacttgtcatccctactatcttctgtctagtcatactcctattcaccgttctcaactactcatacatgccctgctcttgtttacactgccggtttacactgtttctccaagccatcacagctgatatctcctagtgctatccccaaactgccactcttaacttttgaagttaataaataatctttgctgacaggactacgctgaatctccttaggcactctctaatcagatgtcctgagtagtcccaattcttagaccttttatacctgtttttctccttcttttattccatttagtttctcagttcatcccaaaccgtatccaggctatcacccatcattctatacagcaaatgtttcttcaaacaaccccacaatatcaccccttaccacaagatctcccttcagcttaatctctcccactctaggttcccacgccacccctaatcccgcttgaagcagccctgagaaacatcacccattctctctctccataccaccccccaaaaattttcgccgccccaacacttcaacactattttgttttatttttcttattaatataagaaggcaggaatgtcaggcctctgagcccaagccaagccatcgcatcccctgtgacttgcacttatgcccccagatggcctgaagtaactgaagaataacaaaagaagtgaatatgccctgccccaccttaactgatgacattccaccacaaaataagtgaaaatggccggtccttgccttaagtgatgacattaccttgtgaaattccttctcctggctcatcctggctcaaaaagctcccccactgagcaccttgtgacccccactctgcctgccagagaacaaccccccttgcctgtaattttcctttatctacccaaatcttataaaatggccccacccctatctcccttcgctgactctctttttggactcagcccgcctgcacccaggtgaaataaacagccttgttgctcacacaaagcctgtttggtggtctcttcacacagacgtgcatgaaa

SEQ ID NO: 177 - DNA, 10347 bp, Homo sapiens
agagacaggactagctggatttcctaggccaactaagaattcctgagcctagctggggaaggtgactgcacccatctttaaacatggggcttgtaactcagctcacacccgaccaatcaagtagtaaagggagctcactaaaataccaattaggctaaaagcaggaggtaaagaaatagtcaatcatctatcgcctgagagcacagcgggagggacaatgatcaggatataaacccaggcattggagccaacagtagcaacccccttttggtcccctcccattgtatgagagctctgttttcactctattaaatcttgcaactgcacactcttctggtccgtgttttttccggcttgagctgagcttttgcttgccatccaccactgctgatcaccaccgtcgcagacccgtcactgacttccacccctccggatctggcagggtgtctgctgctcttctgatccagtgagacacccattgccactcctgactgggctagaggctcgccattgttcctgcatggctaagtgcccgggttcatcctaatcgagctgaacactagtcgctgggttccacggttctcttccataacccatggcttctaatagagctataacactaaccacatggcccaaggttccattctttggaatccatgaggccaagaaccccaggtcagagaatagaaggcttgctgccatcttgggagcggcccaccaccatcttgggagctctaagaacaaagacccgcttgtaacatttggtggcccatatggggattctccaaagtggtgagtaatactgggccatttttgcttgctattctgtcctatccttccttggaattggaggaaaatatagggcacctatcggctggttaaaaatgattagcgtggccgccggagtgaggctttctggaaaaaggctttctaacaacccccaacccttctgtgttgggagcattggtctgcctggaaccagcttctgttttcacaatattcctgggggaagccgagggccaactagaggcagaaagctgtcgtcctgaactcctggcattggccagttgagatcatggtgcagccagaagtctctactcaacagtcgtccatgcgtgtgcccctacctctccttctgacccatacctcctgggtcctgaccatgactttcttgaaagtgtagccccaaaattctccttacctctgtatctacttcctcctatccctgtctcctaggtactaatgcttcaggctttcacttcctttcccaagtattagagcaagttgtatctccaaagggatctaaggaagctctacactgcatccttaggcacctaggctatgaatgcagggaatcttgtccctggtgtctctcccaatttaggtatacagctctcgacatgggcagttatgtgggatccattccccaccacactagccagggccccaagttctattatgagctgtggaccaagtttgtaaatggctaggaggattgatcttccactgtgtaagatgttcttctcccccaatttctacccagtttacccaccctgtaatacaatctccaagccttggctccttggccagggccttagaactgatgacccagtactttaataattggaactgggtctatgacaacataatagatcaggatgaaaacgaattgagtaaattaaagggaggcacatattcctataacggcaaatgggggcaacgagcgaacgtccttccactgtgttcccaaaatccatctaccaagagaggaattatctctttcacagctttgcctagtgattctatgtaagtcaatactactggaaggacaacatagtgcccagaagtttattaactggactttagcacataaaaaccagcaagcccacgccgggcatggtggctcacacctgtaatcccagcactttgggaggccgagacgggtggatcacctgagatcaggagttcgagaccagcctggccaacatggtgaaaccccgcctctactaaaaatacaaaaattagccgggtgtggtggtgggcgcctgtaatcccagctactcaggaggctgaggcagaagaatcacttgaacctgggaggcagaggttgcagtgagccaagatcacgccactgcactccagcctgggtgatggagcaagactccatctcaaaaaaaaaaaaaaaacaaaaaaaacccagcaagcccatccttttctcattgctctccttctcgtaggaaaaaggcacacaagataaacaggatccatctctcctatttcttacccaaaaggacttaatctggggcaacaagaggtttaagatagataattagggcatattcctgcaaaggaaaagaaggataaaggccctagtggggaaaaattctatctcaatcctgactcaaaaagttacttacaccctctctgaaatgaatttgcataggaactgttgcttatgggaccaactgggttgcaactgggttgcagatggggcaactgggttgttatgaaatactcaggaaaccagcccagctctagaactcacccctgagcacaaaggtgatgttgggcacactggtaaaggaccactagaatccagcagcctggacccctttctttgtggtcaagaaaggcaggaaaacaggtgcaggactgctacatcggtgagcataactaatccgataagcagaggtccatggctggtcacacaccctggaaaggaataagcgttaggaccatagaggacactctaggactaatgctcatcggaaaatgactaggggtgctggcattcctatgttcttttttcagatgggaaatgttcccccggctccttccccaactaataaggaccccccttcaacccaaaccgtccaaaaggagatagacaaaggggtaaacaatgacccagagtgccaatattccccgattatgccccctccaagcggtgggaggaggagaattcagcccagtcagagtgcatgtaccgtttttccctctcagacttgaaacaaactaaaatagacctagataaattctcagataaccctgatggctatattgatgttttataagggttaggacaatcctttgatctgacatggagagatataatgttactgctagatcaaactgtaaccccaaatgagagaagtgctgccataactgcagcctgagagtttggtgatctctggtatctcagtcagttcaatgataggatgataacagaggaaagagaatgattccccacaggccagcaggcagttcccagtgtagaccctcactgggacacagaatcagaacatggagattggtgccgcagacatttgctaacttgcatgctagaaggactaaggaaaactaggaagaagcctatgaattattcaattatgtgcactataacacagggaaaggaagaaaatcctattgccttcctggagagactaagggaggcattgaggaagcatacctctctgtcacctgactctattgaaggccaactaatcttaaaggataagtttatcactcagtcagctgcagacattagaaagaaacttcaaaagtctgccttaggcttggaacaaaacttagaaaccctattgaacttggcaacctcggtttttaataatagagatcaggaggagcaggtggaatgggacaaacgggttaaaaagaaaagccaccgctttagtcatggccctaaggcaagcggacttcggaggctctagagaaaggaaagcctcagcaaatagaatgcctaatagggtttgtttccagtgcagtctacaaggacgctttaaaaaagattgtctggccgggcgcggtggctcacgcctgtaatcccagcactttgggaggctgaggcaggtggatcacaaagtcaggcgatcaagaccatcctggctaaaacagtgaaaccccatctctactaaaaatacaaaaaattagctgggtgtggtggcgggcgcctgtagtcccagctcctcgggaggctgaggcaggagaatggcgtgaaaccgggaggcggaggttacagtgagccaagattgggccactgcactccagcctgggtgacagagcaagactccctctaaaaaaaaaaaaaaaaagattgtctgaatagaaataagccgccccctcgtacatgccccttatgtcacgggaatcactggaaggcccactgccccagggtacgaaggtcctctgagtcagaagccactaaccagatgatccagcagcaggactgagggtgcctggggcaagcgccatcccatgccatcaccctcacagagccccaggtatgcttgaccattgagggccaggaggctaactgtcttctggacagtgcaggcttctcagtcttactctcctgtcccagacaactgtcctccagatctgtcactatccgaggggtcctaggacaggcagtcactagatacttttcccagtcactaagctgtgactggggaacttttttcacatgcctttctaattatgcctgaaagccccactcctttgttagggagagacattctagcaaaagcaggggccattatacacctgaacataggagaaggaacacccattttttgtcccctacttgaggaaggaattaatcctgaagcctgggcaacagaaggacaattggacgagggaagaatgcctgtcctgttcaagttaaactaaaggattccgcctcctttccctaccaaaggcagtacccacttagacccgaggcccaacaaggactccaaaagattgttaaggacccaaaagcccaaggcctagtaaaagcatgcaatagcccctgcaatactccaattttaggagtacagaaacccaatggacagtggaggttagtgcaagatctcaggattatcaatgaggccattgtccctatatacccagctgtacctaacccttatattctgctttcccaaataccagaggaagcagagtggcttacagtcctggaccttaaagatgcctttttctgcatccctatacatcctgactctcaattcttgtttgcctttgaagatccttggaacccaacatctcaacccacctggactgttttaccccaagcggtcagggatagcccccatctatttggccaggcattagcccaagactttagccagttcttatacttggacactcttgtcctttggtatgtggatgatttacttttagctgcccgttcagaaaccttgtgccatcaagccacccaagcgctcttaaacttcctcgccacctgtggctactaggtttccaaaccaaaggctcagctctgctcacagcaggttaaatacttagggctcaaattatccaaaggcaccagggccctcagtgaggaatgcatccagcctatactggcttatcctcatcccaaaaccctgaagcaattaggagggttccttggcataacaggcttctgccgaatatggaatcccaggtatgtcaaaatagccaggccattatacacactaattaaggaaactcagaaagccaacactcatttagtagaatggatacctgaagcagaagcagcttcccaggccctaaagaaggccctaacccaagccccagtgttaagcttgtcaacggggcaagacttttctttatatgtcacagaaaaaacaggaatagctctaggagtccttacacaagtccgagggaccagcttgcaacccgtggcatacatgagtaaggaaattgatgtagtggcaaagggctggcctcattgtttatgggtagtggcagcagtagcagtcttagtatctgaagcagttaaaatgatacagggaagagatcttactgtgtggacatctcatcatgtgaatggcatactcactgctaaaggggacttcgggttgtcagacaaccatttgcttaaatatcaggccagtctattacttgaagggccagtgctgcaactgcacacttgtgcaactcttagccacatttcttccagacaatgaaaaaaagatagagcataactgtcaacaagtgattgctcaaacctatgccactcaaggggaccttctagaggttcccttgactgatccccacgtccccacatcaacttgtatactgatggaagttcctttgtagaaaaatgacttcgaaaggcgaggtatgcagtggtgagtgacaatggaatacttcaaagtaatcccctcactccagaaactagcgctcagctggcagaactaatagccctcacttgggcactagaacacaggagaaggaaaaagagtaaatatatatacagcctataggtatgcttacctagtcctccatgcccacgcagcaatatggagagaaagggaattcctaacttccaagggaagacctatcaaacatcaggaagacattaggagattattattggcggtacagaaacctaaagaggtggcagtcttacactgccagggtcatcagaaaggaaaggaaagggaaatagaagagaaccaccaagcggatactgaagtcaaaagagccgcaaggtgggaccctccattagaaatgcttatagaagggcccctagtatggggtaatcccctccaggaaaccaagccccagtactcagcaggagaaatagaatggggaaccgcatgaggacatagcttcctcccctcaggatagctagccactgaagaaggaaaaatacttttgcctgcagctaaccaatagaaattacttaaaacccttcacccaacctttcacttaggcattgataacacccatcagatggccgaatcattatttactggaccaggccttttcaaaactaccaagcagatagtcagggccggtgaagtgtgccaaagaaataatcccctaccttattgccaggctccttcagaacaaagaacaggccattacccaggaaaatactggcaactagattttacccacatgcccaaatctcagggatttcagtatctactagtttgggtggatactttcactggttgggcagaggccttcccttgtaggacagaaaaggcccaagagataataaaggcactaattcattaaataattcccagagttggacttccccaaggcttacagagtgacagcggccacgctttcaaggctgtaggaacccagggagtatccgaggagttaggcatacaatatcacttacaccatgcctggaggccacaatcctcaggaaaagtcgagaaaatgaatggaacactcaaacaacatctaaaaaagctaacccaagaaacccgccttgcatggcctgctctgttgcctatagccatattaagaatccaaaactctccccaaaaagtgggacttagcccatacaaactgctgtatggacagcccttcctaaccaatgaccctgtgcttgaccaagagatggccgacttagttgcagacatcacctccttagccaaatatcaacaagttcttaaaacactgcagggaaccagccgggcgcagtggctcatgcctgtaatcccagcactttgggaggccgagacgggtggatcacctgagatcaggagttcgagaccagcctggccaacatggtgaaacctcatctctacttaaaatacaaaaaattagctgggtgtggtggtacgcacctgtaatcctaggtattcgggaggctgaggcaggagaatcacttgaacccgggaggtggaggttgccgtgagccgagatcgtgccactgcatgccagactgggggacaagagcgagacatcatctcaaaaacaaacaaacaaaccaaaaaaaccacacattacagggaacctgtcccggagaggagggaaaggaattattccaccctggtgacatggtattggtcaagtcccttccctctaattccccatccctagatacatcctggaaaggacgctacccagtcattttatctaccccaaccgtggttaaagtggctggattggaatcttggatacatcacactcgagtcaaaccctggatagtgccagaggaacccgaaaatccaggagacattgctagctattcctgtgaacctctagaggatctgcgcctgctcttcaagagacaaccgtgaggaaagtaactagaatcgtagatccccatggccctcccttctcatatttttctctttactgttctcttaccccctttcactctcactgcaccttatccatgccactgtactgtcagaagctccccttaccaagagcttctatgaacaatgtagcttcccagaaatattgacgccccatcgtataggattttttctaaaggaaaccccactttcaccgcccacacccgtatgccccacaactgctataactctgctactctttgcatgcatgcaaatactcattattggagagggaaaataattaatcctagttgtcctggagggtttggagccactgtctgttggacttacttcacccatactggtatgtctgatgggagtggagttcaagatcaggcaagagaaaaacacgtaaaggaagtaatctcccagctgacgcaggtacatagatagcacccctatcccctacaaaggactagacctctcaaagctacatgaaaccctccatacccatactcacctggtaagcctatttaataccaccctcattgggctccatgaagccttggcccaaaaccctactaactgttggatgtgcctccccctgcactcaggccatatatttcaatccctgtatctttaacctccttgttaagtttgtctcttccagaatcgaagctgtaaaactacaaatggttcttcaaatggagccccagatgcaatccgtgactaagatctaccacagacccctggaccggcctcctagcctatgctctgatgttgatgacatcaaaggcaaccatcccaaggaaatatcaactgcacgacccctgctacaccccaattcagcatgaagcagttagagtggtcatcggccaacctccccaacagcacttgggttttcctgttgagaggggggactgagagataggactagctggatttcctaggccgacttagaattcttaagcctagctggggatggtgactgcacccacctttaaacacggggcttgtaactcagctcacacccgaccaatcaggtagtaaagagagctcactaaaataccaattaggctaaaggcaggaggtaaagaaatagtcaatcatctatcacctgagagcatagggggagggacaatgaccgggatataagccaggcatttgagccagcagtggcaaccccctttgggtcccctcccattgtatgggagctctgttttcactctattaaatctttttttaaatttattattattattatacttaaagttttagggtacatgtgcacaatgtgcaggttagttacatatgtatacatgtgccatgctggtgtgctgcacccattaactcgtcatttagcattaggtatatctcctaatgctatccctcccccctcccccaaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttcctattgtgaatagtgccacagtaaacatacgtgtgcatgtgtctttatagcagcatgatttatagtcctctgggtatatacccagtaatgggatggctgggtcaaatggtatttctagttctagatccctgaggaatccactctattaaatcttgcaactgcgcactcttctggtccgtgtttcttccggctcaagctgagctttcgctcacagtccaccactgctgattgccgccgttgcagacccgccgctgacttctagccgtccggatccggcagggtgtctgctgtgcttctgatccagcgaggcacccactgctgctctggatggggctagaggctcgccattgttcctgcgtggctaagtgcccgggttcgtcctaatcgagctgaacactagtcgcgggggtccacggttctcttccgtgacccatggcttctaatagagctataacactcaccgcatggcccaaggttccattccttggaatccgtgaggctgagaaccccaggtcagagaacaaaaggcttgccgccatcttgggagtggcccgtcgccatcttgggagctctaagaacaaacacctgctggtaacact

SEQ ID NO: 178 - DNA, 800 bp, Homo sapiens
gagagacaggactagctggatttcctaggccgattaagaatccctaagcctagctgggaaggtgaccgcatccgcctttaaacacggggtttgcaacttagctcacacccaaccaatcagggagtaaagagagctcactaaaatgctaattaggcaaaaacaggaggtaaagaaatagttgatcatctattgtctgagagcacagcaggagggacaatgatagggatataaacccaggcattcgagccagcaacgcagccccttttgggtcccctccctttgtatgggagctctgttttcactctgttaaatcttgcaactgcactctctggtctgtgtttgttacagctcaagctgagctttcgctcgccatccaccactggggtttgccgctgtcgcagacacagacccgccactgacttccatccctctagatccagcagggtgtccactgtgctcctgatccagcaaggcgcccattgccgctcctgattctgctagaggcttgccattgttcctgcacagctgagtgcccaggttcgtcctaatcgagctgaacactagtcactgggttccacgttctcttccgtgacccacggcttctaatagagctataacactcacctcatggcccaagattccattccttggaatctgtgaggccaagaaccccacgtcagagaacacgaggcttgccaccatcttgaaagctgcctgccgccattttggaagcagcccaccaccctcttgggagctctgggagcaaggacccccagtaacacttccacatggcacctatg

SEQ ID NO: 179 - DNA, 2818 bp, Homo sapiens
gtcacgcctctgagcccaagctaagacaacatatcccctgtgacctgcacgtatacatccagatggcctgaagcaagtgaagaatcacaaaagaagtgaaaatggctggttcttgccttaactgagcgattaaccttgtgaaattccttctcctggctcagaaactcccctactgagcaccttgtgaccccctcccctgcccgccagagaaaacccccctttgactgtaattttccactacccacccaaatcctataaaacagccccacccctatttccctttgctgactctctttcagactcagcccgcctgcacccaggtgattaaaaagctttattgctcacacaaagcctgtttggtggtctcttcacatggacacgtgtgacatttggtgccctgactcggatcgggggacctcccttgggagatcaatcctctgtcctcctgctctttgctctgtgagaaacatccacctacaacctcaggtcctcagacgaaccagcccaaggaacatctcaccaattttaaatcgggtaagcagcctctttttactctcttctccaccctctctcactatccctcaacctctttctcctttcaatcttggcaccacccttcaatctctcccttctgttaatttcaattcctttccttttctggtagagacagaagagacgcgttttatctgtgaactcaaaactccggcaccggtcatggactcaggaagacagtcttcccttggtgtttaaccactgtggggatgcctgcttgattattcacccatgattcagaggtgcctaatcaccatgggcacacctgccttgatccttcacatttagtggcaagcaccactttcctggggggcaagcaccctctaccccttctctgcgtgtctctaccctctcttttctctgggcttgcctccttcactatgggcaaccttccaccctccattcctccctcttctcccttagtctgtgttctcaaaaacttaaaacctcttcaactcacacctgacctaaaacctaaatgccttattttcttctgcagcacctcttggccccaatacaaacttgataatggctctaaatggccagaaaacagcactttcaatttctccatcctacaagatctagataattcttgtcataaaatgggcaaatggtctaaggtgcttgatatccaggcattcttttacacatcggcccctccctagtctctgttcccaatgcaactcatcccaaatcttccttctttccctcccgcctgtcccctaggtcccaaccccaagcatcacgagtcttttcaatcttccttttctaccgacccatctgacctctcccctcctccccagactgctcctcctcaggtcgctccctgccaggctgaatcaggctccaattcttcctcagcctctgctcccccaccctataatccttctatcacctcccctcctcacacccagtccggcttacagtttcgttctgccactagccctccccaatcagcccaacaatttcctcttaaagaggtggctggagctaaaggcatagtcaaggataatattcctttttctttatccgacctctcccaaatcaatgagcatttaggctctttttcatcaaatataaaaacccagcccagttcatggctcatttggcagcaaccctaagatgctttacagccctagaccctgaagggtcagaaggccgtgtcattctaaatatgcattttatcacccagtcagctcctgacattagaaaaaagcttcaaaaattagaatccagccctcaaaccccacaacaggaattaatcaacctcaccttcaaggtgtacaataatagagaggagacagccagacagcaacgcatttctgagttacaattacttgcctctgctgtgagacaaaacccagccgcacctccagtgcacaagaacttcaaaatgcctaagcctcacatgcctaagccgcagcggtcaagcattcctacaggacctcctccatcaggatcttgcttcaagtgccagaaatctggccactgggccaaggaatgcccgcagcccaggattccccctaagccatgtcccatctgtgcgggaccccactggaaatcggactgtccaactcacccagcagccactcccagagcccctggaactctggcccaaggctgtctgactgactccttcccagatctccttggcttagcagctgaatactgacgctgcccgatcgccttggaagccccctggaccatcacggacaccatcgagtaactctcacagtggagggtaagtccatcccctgtttaatcaatacaggggctacccactccatattaccttcttttcaagggcctgtttcccttgcccccataactgttgtgggtattgatggccaagcttcaaaaccccttaaaactcccctactctggtgccaacttggacaacgttcttttatgcactcttttttagttatccccacctgcccagttcccttattaggccgagacattttaaccaaattatctgcttccctgactattcctggactacagccacatctcattgccacccttcttctaaacccaaagcctccttcacgtcttcctctcgtatccccccaccttaacccacaagtatgagacacctctactccctccctggcaaccgatcacacacccattactctcccattaaaacctaatcacccttaccccactcaatgccagtatcccatcccacaacaggctttaaggggattaaagcctgttatcacttgcctgctacagcatgggcttctaaaacctataaact

SEQ ID NO: 180 - DNA, 6896 bp, Homo sapiens
gtcaggtctctgagcacaagctaagccattataacccctgtgacctgcacgtatacatccagatggcctggagcaagtgaagaaccacaaaagatgacattccaccattgtgatttcttcctaccccagcccaactaataaatcaaccttgtgacatttctcccctggacaatgagtcttaggatttccccaccctgcacctggtgacccccacccctgcccgcaagagataaccacttttaactgtaattgtccactacctacccaaatcctataaaactgccccacccctatctccctttgttgactcattttttggcctcagcctgcctgcacccaggtgaaataaacagctttattgcttacacaaagcctgtttggtgatctcttcacatggacgtgcgtgaaaacttggtgccgaagacccaggacaggaggactgcttcgggagactggtcccctgtcctcaccctcactccgtgaggagatccacctacgacctcaggtcctcagaccaaccaacccaaggaacatctcatgaatttcaagtcgggtaagcggtcttttcactctcttctctagcctctctcactacccttcaatctccctgtccttccaattccagttctttttcctctctagtagagacaaaagagacacattttatccgtggacccaaaactccggtgctggtcacggactcgggaagacagtgttcccttggtgtttaatcactgtggggacgcctgcctgattattcacccacatttcagaggtgtctgatcaccacggggacacctgcgttgatccttcaccttggtggcaagtaccacctctccttggcggcaagtaccacctaccctgggtggcaagtaccacctcctctgggcgggaagtaccacccccctctctccgtgtctctaccctctcttttctctaaacttaccgttttattgtgggcaaccttcctccctccattcctccttctcccttagcctgtgttctaaaaaacttaaaaccccttcaactcacaactgacctaaaacctaaatgccttattttcttctgcaatactgctaggccccaatacaaacttgaaaatggctctaaatggccagaaaatggcactttcagtttctccatcctacaagagctagataatttttgtcgaaaaatgggcaaatggtctgaggtgcctgacgtccaggcattcttttacacatcggtccctccctagcctctgctcctaatgcaactcatcccaaatctttcttctttttctcctgtctgttccttcagtctccaccccaagctgtgggtcctttgaatcctccttttctatgaacccatctgacctctcccctctttcccaggctgctcctttcgaggtcccaattcttcctcagcctccgctcccccaccctataatccttctatcacctcctctcctcacacccggtccagcttacagttttgttctgcgactagccctccccagcctgcccaacaatttcctcttagagaggtgactagagctgaaggcacagtcaaggttaatgctcctttttcttcatccgacctctcccaaatcagttagtgtttaggctttttttaatcaaatatgaaaacccagcccagttcatggcccatttggcaacaacccttagatgccttactgccctagacacagaggggctagaaggctgactaattctcaatatgcattttatcactcagtccactcctgacattagaaaaagctccaaaaattaaattctggccctcaaaccccacaacaggacttaattaacctcaccttcaaggtctgcagtaatagagaagaggcagccaagtggcaacctatttctgagttgcaattacttgcctccgctgtgagagaaaccccagccacatctccagcacacaagaacttcaaaacacctaaaccgcagtggccaggcgttcctccaggacctcctcccccaggatcttgcttcaagtgccagaaatctggccaccaggccaaggaatgcccgcagcccgggattcctcctaagccgtgtcccatctgtgcaggaccccactagaaatcagactgtccaacttgcccagcagccactcctgtagcccctggaactctagcccaaggctctcggactgactccttcccagatctcctcagctcagtggctgaagagtgacactgcctgattgcctcagaagcctcctagaccatcacagatgctttgggtaacccttacagtggagggtaagtccgtccccttcttaatcaatatggaggctacacactccacattaccttcttttcaagggcctgtttcccttgcctccataactgttgtgggtattgatggccaggctgctagaccccttaaaactccccaactctggtgccaacttggacaacattcttttatgcactcctctttagttatccccacctgcccagttcccttattaggtcaagacattttaacaaaattatccgctaccctgactattcctggacttatagccacatctcattgctgcccttctccccaaccaaaagcctcctttgtgtcttcctcttgtatcccccccccaacttaacccacaagtatgggacacctctactccctccctggcaaccgatcacatgcccattactatcccaataaaacctaatcaactttactccactcagtgccagcatcccatcccacgacaggctttaaggggactaaagcctgttatcactcacctgctacagcatgggcttctaaagcctataaactctccttccaattcccccattatacctgtccaaaaaccagacaagtcttacaggttagttcaggatctgtgccttatcaaccaaattgtcttgcctatccaccccatggtgccaaacccatatactctcctattttcaatacctcccttcacaacccattattcggttctggatctcaaagatgctttctttactattcctttgcacccttcatcccgcctctctttgcttttacttggactgaccctgacaccaatcattctcagcaacttacctgggctgtatttccacaaggcttcagggacagccctcattacttcagccaagctctttctcatggtttactttctttccaccactctgcttctcaccttattcaatatattgatgaccttctactttgtagcccttcctttgaatcttctcaacaagacaccctcctgctccttcaacatttattctccaagggatatcgggtattcccctccaaagctcaaatttcttctccatccattacctacctcagcataattcttcatgaaaacacgcatgctctccctgccaattgtgtctggctgatctctcaaaccccaaccccttctacaaagcaacaactcctttccttgctgggcatggttggatacttttgcgtttggatacctggttttgccatcctaacaaaaccattatataaactcacaaatagaaaactagctgaccccatagatcctaaatcctttccccactcctctttccattccttgaaagcagcttgagaaactgctcccacactagctgtccctaactcatcccaaccctttttcattacatacagccaaagcatagggctgtgcggttggaattcttacacaagagctgggaccatgtcctgtagcctttctgtccaaacaacttgaccttactgttttaggctggaccccacattattcctgataccacacctgacccccatgactgtatctctctgatccacctggcattcactccatttccccatatttccttctttcctgtccctcaccctgatcacacttggtttattgatggcagttccaccatgcataattgccactcaccagcaaaggcaggctatgctatagtatcttccacatctatcattgaggccaccactctgccctattccactacctctcagcaagccgaactcattgccctaacttgagccctcactcttgcaaaaagactacgcatcaatatttatactgactttatatgccttccatatcctgcaccaccatgctgttatatgggctgaaagaggtttcctcactattcaagggtcctccatcattaatgcctctttaataaaaactcttctcaaggccgctttacttccaaaggaagctggagtccttcactgcaaaggccatcaaagggcctcagaccccattgctgataagacagctaaagatgcagccagtattcctatttctgtccctcatgaccagtttttctccttctcatcagtcactcctacttattctcccactgaagtttctacctatcaatcactccccactcagggcaaatggttcttggaccaaggaaaatatctccttccagcctcacaggcccattccattctgttgtcatttcataacctcttccatgtaagttacaagccactagcctgtctcttagaacctctcatttcctttccatcgtggaaatctgtcctcaaggaaatcacttctcagtgttccatctgctattctactactcctcagggatttctcagtccccctcccttccctacacatcaagctcggagatttgcccctgcccaggactggcaaattgactttactcacatgccccaagtcaggaaactaaaatacctcttggtctgggtagacactttcactggatgggtagaggcctttcccacagggtcttcgaaggccaccacagtcatttcttcccttcagtcagacataattccttggtttggccttcccacctctatacagtccgataatggaccggccttggtattcagtggaaacttcataccccttactgtcctcaatcttcaggaaaggtagaatggactaatggtcttttaaagacacacctcaccaagctcagcctccaacttaaaaaggactggacagtacttttacctcttgcccttctcagaattagagcctgtcctcaagatgtacagtccatttgaacttttatatggatgcactttcttgctcggccccaacttcatcccagacaccagccctctaggtgactatcttccagtcctccagcaggctagacagaaaattcgccaggctgctaatcttcttttgcctactccagattcccagccacatgaagacaccctagctggacgatcagttcttgttaagaatctgacccctcaaactctacaacctcgatggaccagaccctacttagtcatctatagtaccctacgtaccatctgcctgcaggaccctccccattaggttcactgatccagaataaagctgtgtccatcagacagccagcctgatctctcctcttcctcctggaagttgcaagtactcacccctacttcccttaaactcactcacattcctaaaggataatagtaacccttataatcctaacacatcctttcattcttattaggtctcttcttccttaccctactctttgcaacagggctttatgcagtcaccccccaacttggactgcaccccaaaaactagtcatccctactctcttctgtccagtcatactcctattcaccattttcaactactcataaatgccctgcccctgtttacactgctggtctacacttttcctccaaaccatcatagtggatatctcctggtactatccccaatctgccactcttgactccttcttggagtggatagatgatctttgctgacagggcaccctctgacactttcaccctgataaagtcctattatttacttttatactccctcttattcttgttcccgttcttatgccaccctctacctctccccagctatctccaccacactatcaatcttactcactctctcctagccatttctaatccttctttaacaaacaattgctggctttgcatttctctttcctccaaaaccactgaggccttgacgtactcactgctaaaaaaaggggactctgtatatttttaaatgaagagtgttgtttttacctaaatcaatctggcctggtatatgacaaaagaaaaaaaaaaaacactcaaggatagagctcaaaaactcgctactcagacaactgattaaactggacccacctggccactctctaactgggtatcctggcttcttccgatcgttagtctgatacctatcttcctctttctcttattcaggccttgtgtcttctgattaatctctcaattcatacaaaaccgcatccaggccaccaccaatcattctatacaaatgctctttctaataactccacaatattaccccttaccccaaaatctttcttcagtttaatctctcccactcaagtttcccacattgccccaatcctgctcgaagcagccctgagaaacatcacccattatctctccataccaccctcaaaaattttcgccgccccaacacttcaccactatttcattttgtttttcttattaatataaaaagacaggaatgtcaggcctctgagcccacgctaagccatcataacccctgtgacctgcacgtatacatccagatggcctggggcaactgaagaaccacaaaagatgacattccaccattgtgatttcttcctaccccagcccaactaatcagtcaaccttgtgacattcccccgctggacaatgagtctcatgatctccccaccctgcaccttgtgacccccacccctgcccgcaagagataaccacctttaactgtaattttccactacctaccccaatcctataaaactgccccaccccatctccctttgctgactcctttttcggcctcagcctgcctcagccaggtgaaataaacagcattattgctcatacaaagcctgtttggtggtctcttcacacggatgcacatga

SEQ ID NO: 181 - DNA, 7906 bp, Homo sapiens
gtcaggcctttgagcccaagctaagccatcatacccctgtgacctacacgttatacatccagatggcctgaagcaattgaagatccacaaaataagtgaaaatagccttaacggatgacattccaccattgtgatttgtttccaccccaccctaactgatacatatattctcccccacccttaagaaggtacttcggaatgttctctcccgctcttaagaatgtgctttgtatgcctatcccaaacctgtaagaactaatgataatcccaccaccctttgctgactcttttttttggactcagcccatctgcactcaggtgaaataaacagccttgttactcacacaaagcctgtttggtggtctcttcacatggatgtgcgtgacatttggtgccgtgactaggattgggggccctcccttgggagatcaatcccctgtcctcctgctctttgctccatgagaaagatccacctacgactttgggtccttagaccaaccagcccaaggaacatctcaccaattttaaatcgggtaagcagcctctttttactctcttctccagcctctctcagtatccctcaatctctttctcctttcaatcttggcaccatccttcatttctcccttgtcttaatttcagttcatttccttttctggtagagacagaggagatgcgttttatccgtgaacccaaaactccggcactggtcatggattcaggaagacagtcttcccttggtgtttaatcactggagggatgcctgcttgattattcacccacgtttcagaggtgtctgatcacagtggggatgcctgctttgatccttcacccttagtggcaagcaccactttcctggggggcaagcacaccccactccttctctttgtgtctctaccctctcttttctctgggcttgcctccttcactatgggcaaacttccaccgtccattcctccttcttctcccttagcctgtgttctcaaaaacttaaaacctcttcaactcacacctgacctaaaacctaaatgccttattttcttctgcaatgctgcttaaccccaatacaaactcgacagtggttccaaatagccagaaagtggcacttttgatttttccatccaacaagatctagataattcttgtcgtaaaatgggcaaactgtctgagctgcctgatgtccaggcattcttttacacatcagtccctctctagtctctgttctcaatgtgactcgtcccaaatcctccttgtttccctcctgcctgtcccctcagtcccaaccccaagcatcactgtgtcttttcaatcttccttttctacagacccatctgacctctcccctcatccccagactgctccacctcgggtcactccctgccaggctgaatcaggctccaattctttctcagcctccactccccctaccctataatccttctatcaactcccctcctcacacccggtctggcttacactttcgttccacgactagccctctcccacttgcccaaaaatttcctcttaaagaggtggctggagctaaaggcatagtcagggttaatgctcctttttctttatccgacctctcccaaatcaattggcatttaggctctttttcatcaaatataaaaacccaactcagttcatggctcgtttggcagcatccctgagatgctttacagccctagaccctgaaaggtcagaaggccgtcttattctcaacatgcattttattacccaatccactcccgacattaaaaaagctccaaaaattagattctggccctcaagccccccaacaggacttaattaacctcgccttcaaggtatacaataatagagtagagtcagccaagtggcaacatatttctgagttgcaattccttgcctccactgtgaaagaaaccccagccacatctccagcacacaagaacttcaaaatgcatacaccgcagtggtcaagcattcctacaagacctcttccatcaggattttacttcaagtgccagaaatctggccactgggccaaggaatatctgcagtccgggattccttctaagccgtgtcccatctgcacaggaccccactgaaaatcagactgtccactgaaactcacccggcagccactcccagagcccctagaactctggcccaaggctttctgactgactccctcccagatcttcttggcttagtgactgaagactaatctcccaatcacctcagaagcttcctggaccatcacagatgctttgggtaactcttacagtggagggtaagtccgtccccttcttaatgtggagcctacccactccacattaccttcttttcaatggcctgtttcccttgcccccacaactgttgtgggtattgacggccaagcttcaaaaccccttaaaacttccccactctggtaccaacttggacaatattcttttatgcactcttttttagttatccccacctgcccagttcacttattaggctgagacattttaaccaatttatctgcttccctgactattcctggactacagccacatctcattgccacccttcttcccaacccaaagcctcctttgcatcttcctctcatatccccctaccttaacccacaaatatgggacaactctactccctttcctggcaaccgatcacatgcccattactagcccattaaaacctaatcacccttatcctgctcaatgccagtatcccatcccacaacaggctttaaggggattgaagcctgttatcactcacctgccactgcatgtacttctaaaacttataaactctccttacaattctcccattttacgtgtccaaaaactggacaagtcctacaggttagttcaggatctgcaccttatcaaccaaattgttttgcctatccaccctgtggtgctcaacccatacacccttttgttctcaataccttcctccacaactcactattccgttcttgatcttaaagatgcttttttcactattcccctgcaccccttgtcccagccactccttgcttttacctgggatgaccctgacacccatcagtcccagcagcttacctgggctgtactgccacaaggcttcaggggtagccctcattacttcagccaagctctttctcatgatttactttctttccacccctccacttctcaccttattcaatatattgatgaacttctactttggagcccctcctttgaatcttctcaacaagacaccctcctgctccttcaacatttattctccaagggatatcgggtatccccctccaaacctcaaatttcttctccatctgttacctacctcggcataattcttcatgaaaacaaacttgctctccctgctgattgtgtctgactgatctctcaaaccctgaccccttctacaaaacaacaactcctttccttcctgggaatggttggataatttttagaggccctcaaaatcacaaactatgctcaactcactctctgcagttctcataacttccaaaatcaattttcttcctcacacctgacacatatactttctgctccccgactccttcagctatactcactctttgttgagtctccctcaattgccattgttcctggcccagacttcaatctagcctcccacattattccagataccacacctgacccccatgatggtatctctctgatccacctgacattcaccccatttccccatatttccttctttcctgttcctcaccctgatcacacttggtttattgatggcagttccaccaagcctaatcatcactcaccagcaaaggcaggctttgctatattatctttcacatttatcattaaggctaccgctctgccccctccactacctctcagcaagccaaactcattgcctttacttgagccgtcactcttgaaaagggactacgtgtcaatatttataccgactctaaatatgccttccatatcctgcaccaccatgctgttataggggcagaaagaagtttcctcactacacagggttcctacatcattaatgcgtctttaataaaaactcttctcaaggccactttacttccaaaggaagctggagtcattcactgcaaggaccatcaaaaggtgtcagatcccattgctctggggagcgcttatgctgataaggtagctaaagaagcagctagtattccaacttctgtccctcatggccagtttttctccttgtcattggtcactcccacctactctcccatgaaacttccacctatcaatctcttcccacacaaggcaaatggttcttagaccaaggaaaatatccccttccagcctcacaggcccattgtattctgtcatcatttcataacctcttccatgtaggttacaagttgctagcctgcctctttagaacctttcatttcctttccactgtggaaatctatcctcaaggaaatcacttctcagtgtcccatctgctattctactacccctcagggattgttcaggccccctcctttccctacacatcaagctcagggatttgctcctgtccaggactggcaaattgactttactcacatgccccgagtcaggaaactaaaatacctcttggtctgggtagacactttcactggatgtgtagaggactttctctcagggtctgagaaggccaccatggtcatttcttcccttctgtcagacataattcctcagtttggccttctcacctgtatacagtccaataacagaccatcctttactagtcaaatcacccaagcagtttctgaggctcttggtattcagtggaaacttcataccccttaccattctcaatcttcggaaaggtagaacagactaatggtcttttaaagacacatctcaccaagctcagcctgtaacttaaaaaggactggacagtacttttacctcttgcccttctcagaattagagcctgtcctcaagatgctacagggtacagtccatttaaacttttgcatggacgtactttcttgcttggcccccaacctcatcccagacaccagccctctaggcgactatcctccagtcctccagcaggctagataggaaatttgccaggctgctaatattctcttgcctactccagattcccagccatatgaagacaccctagctggatggtcagttcttgttaagaatctgacccctcaaactctacaacctcaatggaccggaccctacttatctgtagtaccccaactgccgtttgcctgcaggatcctccccactgggtttactgttccagaataaagctgtatccaccagacagccagcctaatctctcctcttcctcctggaagtctcaagtactctcccctacttcacttaaactcactcacatttttgaagaacagtaataactcttatgaacctaatacatcgtttcattctattaggtctattcgtccttaccctactttttgcaacaggactttatgcagtcacccccactacttggcctgaccccccaaaacttgtcatccctactgtcttctgtccagtcatactcctattcaccattctcaactactcataaatgccctactcttgtttacactgccagtttacactgtttctccaagccatcacagctaatatctcctggtgctatccccaaaccaccactctttactccctcttagagtggatagatgatctttggtggcaggacaccctccaatactttcaccacactatcaatctcattcactctttcctagccatttctaatccctccttagtgaacaattgctggctttgcatttccctttcttcctgtgcctatacagctgtccccgccttacagacagactgggaacatctcctgtctccctacacctccgaacttcctttaaccgccctcacctttgccctcctgaagaacttctttactttctagacaggtccagcaagacctcctcagacatttcacatcagcaagctgccaccctcctccgcacttacttaaaaaacctttctccttatatcaactctactccccccatatttggacccctcagaacacaaactactattcctgtggccactcttttatgtatctctcagcaaagacccactggaattcccctgggtaacctttcatcttctcggtgttccttcagtcttcatctccaaagttcaactacacacatcactgaaacagttggaggcttccagctccatattacagataaaacctctatcaatactggcaaacttaaaaacatcagcagttattattgcttaggaagacacttaccctgtatttcactccatccttggctaccttccccttgctcgtcagactctcctcccaggccctcttcttatttacttatacccagccccataaataacagtgaaaggttgctcatagacactcaacgttttctcacacaccatgaaaatcaaacctctatgcagttatcccatcagtccccattacaactgctgatggctgtcaccctagctggatccctaggagtctgggtacaaaacagcttttttagtactccttctcatctttttactttgcatttccagttttgccttgcacaaggtctcttcttcctctgtggatcctctacctacatgcaaattggacaggcacatgcacactagttttccttactcccaaaattcaatttgcagatgggactgaagagcttcctgttcccctcataacactgacacaacaaaaaagaattattccactaattcccttgcttgtctgtttaggactttctgcctccactattgctcttggtactgggatagcaggcatttcaacctctgtcatgaccttccatggcctctctaatgactctccgctagcatcacagacatatcacaaactttatcagtccttcaggcccaagttgactctttagctgcagttgtcctccaaaacctccaaggccttgactttcactgctgaaaaaggaggactctatatttttaaatgaagagtgttgtttttacctaaatcaatctggcctgatgtatgacaacataaaaaaactcaaggatagagcccaaaaacttgccaaccaagcaagtaattatgctgaacctccttgggcactctctaattggttgtcttgggtcctcccaattcttagtcatttaatacctgtttttctccttctcttattcggaccttgtgtcttctgtttagtttctcagttcatccaaaaccatatccaggctgtcatcaatcattctatatgacaaatactccttctaacaaccccacaatatcaccccttaccacaaaatcttccttcagcttaatctctcccattctaggttctcacgccactcctaatcccacttgaagcagccctgagaaacatcacccattttctttccataccacccccaaaaattttcacagccccaacacttcaccactattttgtttttttcttattaatataagaagacaggaatgttaggcctctgagcccaagctaagccatcatataccctgtgacctgcacatatacatccagatggcctgaagcaactgaagatccacaaaagaagtgaaaaaagcaataactgatgacattccaccattgtgatttgttcttgccccaccctacatgtattctcccctgcccttaagaaggtactttgtaatattctctcccaccgctgccccctgcctttaagaaggtactttgtaatattctcccctacccttaagaatgtactttgtatgcctattcttaaacgtataagaactaatgataatcccaccaccctttgctgactctcttttcggactcagcctgcctgaatataggtgaaataaacagacttgttgctcacacaaagcctgtttggtggtctcttcacacggacacgcatga

SEQ ID NO: 182 - DNA, 4871 bp, Homo sapiens
gtcaggcctctgagcccaagctaagccatcatatcccctgtgacctgcacgtatacatccagatggcctgaagcaactgaagatccacaaaagaagtgaaaataaccttaactgatgatactccaccactgtgatttgtttctgccccaccttaactgatcaacgtgctttgtaatcgcccccacccttaagaaggttctttgtatttctccccacccttgagaatgtactttgttagatccaccccctgccacaaaacaccactcctaactccaccgcctatcccaaaacctgtaagaactaatgataatcccaccaccttttgctgactctctttttggactcagcccgcctgcacccaggtgaaataaacagccttcttgctcacacaaagtttgtttggtggtctcttcacactgacgcgtgagacatttggtgctgaagacccgggtcagagggactccttcggaagaccagtcccctgtcctcgcctcactccatgaggagatccacctacaacctcgggtcctcagaccaaccagcccaaggaacatctcaccaatttcaaatcgggtaagcggtcttttcactctcttctccagcctctctcgctacccttcaatctccctgcccttccaattccagttctttttcctctctagtagagacaaaggagacacattttatccatggacccaaaactctggcgccagtcacagactcgggaagacagccttcccttggtgtttaatcattgcagagacgcctgcctgattattcacccacaattcactggtgtctgatcactgcagggacgcctgccttggtcattcacccacattcccatggtggcaagtcaattgcggggatgcctgctttggctcctcacccacactgcagcccagggctgctccccaccaccccgcttctccgtgtctctacctttctctttaaacttaccttcttcactatgggcaaccttccaccctccattcccccttcttctcccttagcctgtgttctcaagaacttaaaaccccttcaactcacacctgacctaaaacctaaatgccttattttcttctgcaataccgcttgaccccaatacaaactcgataatggttctaaatagccagaaaatccattttacaagatctagataatttttgtcgaaaaatgggcaaatggtctgaggtgcctgacatccaggcattcttttacacattggtccctccctagtctctgctcccaatgcgactcatcccaaatctttcttctttctctcctgtctgttccttcagtctccacaccaagctctgagtcctttgaatcctccttttctacagacccatatgacctctcctccccaggctgctcctcaacaggctgagccaggtcccaattcttcctcagcctctgctccccgaccctataatctttttatcaactcccctcacacccattctggcttacagtttcattccgcgactagccctcccccacctgcccaacaatttcctcttaaaaaggtgactggagctgaaggcatagtcaaggttaatgttcctttttctttatccgacctctcccaaatcagttagcgtttaggctctttttcatcaaatataaaaacgcagcccagtccatggcccgtttggcaacaaccctttgacgttttactgccctagacccacaggggccagaaggctgtcttattctcaatatacattttattaaccagcccactcccaacattaaaaaaagctccagaaattagattctggccctcaaaccccacaagaggacttaattaacctcgccttcaaggtgtacaataatagagtagaggcagccaagtagcaatgtatttctaagttccagttccttgcctccactgtgagacaaaccccagctacattgccagcacacaagaactccaaacacctgaagtgcagctgccaggggttcctccagaacctcttccccaggagcttgcttcaagtgccagaaatctggccactgagccaaggaatgccctgcagcccgggattcctccttagccgtgtcccatttgtacaggaccctactggatatcagactgtccaactcgcccggcagccactcccagagcccctggaactctggcccaaggctctctgactgacttcttcccagatcttctcagcttagtggctgaagaccgacgctgcccgatcgcctcagaagcttcctggaccatcacagacgctctgggtaactcttacagtggagggtaagtccgtctccttctaaattaatatggaggctacccactccacattaccttattttcaacgacctgtttcccttgcccccataactgttgtgggtattgatggccaggcttctaaacctcttaaaactccccaactctgatgccagcttggacaacattcttttatgcactcctttttagttatccccacctgcccagctcccttattagatcaagacattttaactaaattatctgcttccctgactattcctaagctacagccacacctcattgccacccttcttcccaacccaaagcctccttcacatcttcctcttgtatccctccaccttaacgcacaggtacgggacacctctactccctccctagcaaccgatcacatgccccttaccatcccattaaaacctaatcacccttaccccgctcaatgccaatatcccatcccacagcacgatttaaaaggattaaagcctgttatcacttgcctgttacagcatggccttttaaagcctataaactctccttacaattcccccattttaccttgtcaaaaacctgacaagtcttataggttagttcaggatctgtgccttagcaaccaaattgtcttgcctagccaccctgtggtgccaaacccatatactctatcctcaatacctccctccacaacccattattctgtcctagcaaacctagctgaccccatagatcctaattcctttcgccactcctctttccattccttaaaaacagccctagaagctgccaccacgctagctctccctaactcatcccaacccttttcattacacacagccaaagtactgggctctgcggtcaaaattcttacacaagagccggaaccgtgccctgtagcctttctgtccaaacaacttgaccttactattttaggctggccatcatgtctccgtgcagaggctgccgccgctctaatacttttagaggccctaaaaatcacaaactatgctcaactcactctctacagttctcataacttccaaaatctattttcttcctcccacctgatgcatatactttctgctccccggctccttcagctatactcactctttgggtctcccacaattaccactgtttctggcctggacttcaatctggcctcccacattattctggataccacacctgacccccatgactgtatctctctgatccacttgacattcactccatttccccatatttccttctttcctcttccccatcctgatcacactcagtttattgatggcagttccaccaggcctaatcgccactcaccaacaaaggcaggctatgctatagtatcttccacatctatcattgaggctaccgctctgcccctctccactacctctcagcaaggcgaactcatgccttaacctgagccctcactcttgcaaaaggactacgcatcaatatctatactgactcgaaatatgccttccatatcctgcaccaccgtgctgttatatgggctgaaagaggtttcctcaccgtgcaagggtcctccatcattaattcctctttaataaaaactcttctcaaggccgctttacttccaaaggaagctggagtcattcactgcaagcaagggccatcaaaaggtgtcagatctcatcgttcagggcaacgcttatgctgataaggtagctaaacaagcagctagcgttccaacttctgcccctcatggccagtttttctccttctcgtcagtcactcccacctactctgccactaaaacttccacctatcaatgtcttcctacacaaggcaaatggttcttggaccaaggaaaatatctccttccagcctcacaggcccattctattctgtcgtcatttcataacctcttccatgtaggttacaagccgctagcccatctcttaaaacctctcatttcctttccatcgtgaaaatctatccccaatccaccactcttgcctccctcttggagtggatagatgatctttgctgacagaacacactccaatactttcaccctgatgaagtcttattctttacttttatactcattcttattcttgttcccgttcttatgccacccactacctctccccagctatctctatcacactatcaatcgcactcactctctcctagccatttctaatccttctttaacaaacaattgctggctttgcatttcttttttctccaaaatcaccgaggccctgacttactcactgctaaaaaaaggggactccgtatatttttaaataaagagtgttgtttttctgtaaatcaatctggcctggtatatgacaacataataaaactcaaggatagagcccaaaaattcgccaaccaagcaagtaattatgctgaacccccttaggcactctctaattggatgtcctgggtcctcccaactctcagtcctttaatacctgtttttctccttcttttattcagaccttctaacttctgtttagtttctcaattcatacaaaactgtatccaggccatcaccaatcattctatatgacaaatgtttcttctaacaaccccacaatatcaccccttaccacaaaatcttccttcaacttaa

SEQ ID NO: 183 - DNA, 2524 bp, Homo sapiens
acccaaaagcaactaagagggttccttggcataacaggcttctgccgaatatggattcccaggtacagcgaaatagccaggccattatatacactaattaaggaaactcagaaagccaatacccatttagtaagatggacacctgaagcagaagcggctttccaggccctaaagaaggccctaacccaagccccagtgttaagcttgccaatggggcaagacttttctttatatgtcacagaagaaacaggaatagctctaggagtccttacacaggtccgagggatgagcttgcaacacgtggcatacctgagtaaggaaattgatggagtggtaaagggttggccccattgtttacggatagtggcagcagtagcagtcttagtatctgaagcagttaaaataatacaggtgatcttactgtgtggccatctcatgatgtaaacagcatactcactgctaaaggagacttgtggctgtcagacaaccatttacttaaatatcaagctgtattacttgaagggccagtgctgcgactgtgcacttgtgcaactcttaacccagccacatttcttccagacaatgaagaaaagatagaacataactgtcaacaagtaattgctcaaaccagtgccgctagaggggaccttttagaggttcccgtgactgatcccgacctcaacttgtatactgatggaagttcctttgtagaaaaagggctttgaaaagcagggtatgcagtggttagtgataatggaatacttgaaagtaatcccctcactccaggaactagtgctcagctggcagaactaatagccctcactcgggaactagaattaggagaagggaaaagggtaaatatatatacagactctaagtatgctcacctagtcctccatgcccatgcagcagtatggagagaaagggaattcctaacttccaaggaaacacctatcaaacatctggaagccattaggagattactattggctgtacagaaacctaaagaggtgacagtcttacactgccggggtcaccacaaaggaaaggaaagggaaatagaagggaaccgccaagcagatattgaagccaaaagagccacaaggcaggaccctccattagaaatgcttatagaaggacccctagtatgaggtaatcccctccaggaaaccaagccccagtactcagaagaagaaatagaatgaggaacctcaagaagacatagtttcctctcctcaagatggctagccaccgaagaaggaaaaatacttatgcctgcagctaaccaatggaaattactttaaacccttcaccaaatctttcacttaggcattgatagcacccatcagatggccaaattattatttactggaccaggtctttcaaaactatcaagcagatagtcagggcctgtaaagtgtgccaaagaagtaattccctgcactgcaggccatacatttcaatccctgtatctttaacctccttgttaagtttgtctcttccagaattgaaactgtaaaactacaaatggttcttcaaatggagccccagatgcagtccatgactaagatccaccacagacccctggaccagcctgctagcccatgctccgatgttaatgacatcgaaggcaccccccccgaggaaatctcaactgtgcaacccctactatgccccaattcagcaggaagcagttacagcggtcatcagccaacctccccaacagcacttgggttttcctgttgagagggggcactgagagacaagactagctggatttcctaggccgactaagaatccctaagcgtagctgggaaggtgactgcatccacctttaaacatggggcttgccacttagctcacacccaaccaatcagagagctcactaaaatgctaattaggcaaaaacaggaggtaaagaaatagccaatcaccttttgcctgagagcacagcaggagggacaaggatcgggatataaacccgggcattcaagccggcaatggcaaccccctttgggtcccctccctttgtatgggagctctgttttcactctattaaatcttgcaactgcactcttctggtccatgtttgttacggctcgagctgagctttcgctccccgtccaccactgctgtttgccactgtcgcagacctgccgctgactcccatcctgctgctgactcccatccctccagatccggcagggtgtctgctgtgctcctgacccagtgagactcccattgccactcccgatcgtgctaaaggcttcccattgttcttgcacggctaagtgcctgggttcgtcctaatcgagctgaacactagtcactgggttccacagttctcttccgtgacccacggcttctaatagagctataacactcatcgcatggcccaagattccattccttggaatccgtgaggccaagaaccccaagtcagagaacacaaggcttgccaccatcttggaagcggctcaccaccatcttgggagctctgtgagcaaagacccacggtaacact

SEQ ID NO: 184 - DNA, 700 bp, Homo sapiens
ttacagtagatagtagggcagagatgagcaggatgggagacggccctctcacctcccaaggaatgtcagaggactatcaggtgatgttcaggaggttgttaaactgtctctctaaaatagtaattggtcacagccaaatccagggaaaggtcagtctcctaataggtagaatctggtgattagcagtttcctgataagatctcaggagttgggtgattgggctcaaggatgtgcagtgcaaggcaaaatggtggagtttaactggtctatgaccttcctctaggaatgctcgactggtaaggggaaaagcacctcaagtgagcatgtgcacaacttcagtaaacacactgcgcatgcagcccctcccaagtgctagcaatgccactgcacatgcagacagcccaccccaagggaagaatcagagaagagacgcaagacccctgaaccatgccattgtaaaaccccaagtcaaaggtcaactgtacacttgaatctctcaagttgcccgcttgaccctcttccaagtgtaatttacttcttttcattcctgctgtaaaactttttaataaactttcactactggtttcaagcttgcctcagtctctcatgtgctttatgccccctcggttgaattctttcttccgaagaagcaagaattgaggttgctgcagacctgtatggatttgccgctgctaacata

SEQ ID NO: 185 - DNA, 6412 bp, Homo sapiens
gacagacaggactagctggatttcctaggccaactaagaatccctaagcctagctgggaaggtgaccgcatccacctttaaacacggggcttgcaacttagctcacacccaaccaatcagagagctcactaaaatgctaattaggcaaaaacaggaggcaaagaaatagccaatcatctattgcctgagagcacagtgggagggacaaggatcgggatacaaacccaggcgttcaagctggcaacagcaaccctctttgggtcccctctctttgtgtgggagctctgttttcactctatttcactctattaaatcttgtaactgcactcttctggtccatgtttgttatggctcgagctgagctttcgctcgccatccaccactgctgtttgccgccatcgcagacccgccaccgcagacctgccactgcagacccaccactgactcccatccctccggatccagcagggtgtccgctgtgctcctgatccagcgaggtgtccattgccactcccaatcaggctaaaggcttgccattgttcctgcacagctaagtgcctgggttcatcctaatcaagctgaacactagtcactgggttccacggttctcttccgtgacccatgtcttctaatagagctataacactcaccgcatggcccaagattccattccttggaatccgtgaggccaagaaccccaggtaagagaacacgaggcttgccaccatcttggaagtggcctgccaccattgtggaagtggcccacaaccatcttgggagctctggaagcaaggacccccggtaacattttggtgaccacgaagggacatccaaagcggtgagtaatattggaccactttcgcttgttattctgtcctatccttccttagaattggaggaaaatactgggcacctgtcagccagttaaaaacgattagcgtggccgccggacttaagactcaggtgttacgctatctgcggaagggctttctaacaacccccaacccttctgggttggggacgttggtctgcttggagccagcttccactttcaattttcttggggaatccgagggctgactagaggcagaaagctgtcgtccagaactcccggcattagcctgttgagatcatggcgcagccagaagtctctactcaacagtcgcccatgggtgcgcccctacctttccttctgacccatacctcatgggtcctgaccacgactttcttgaaagtgtagccccaaaattctccttacctttgaatctacttcctctgatccctgcctcctaggtactaatggttcacactttcatttcctctagcaagttgtatctccaaagggatctagggaggctctgcgttgtgtccttaggcacctgggctgtaacccagggagtcttatccctggtgtccctcctgattcaggtatgcagctctcgacatgggcagttatgtgggacccgttccccactacccttgccagggccccaagtttgtaatggctgagagagagagagacggagagagagggagagacggagagagagacaaagacagagtcaaagagaaaaagaaagaaaaagatagaataaaaaaaaaaagtgtgccctattcctttaaaagccagcgtaaatttaaaacctgtaattgataattgaaggtcttctctatgactctataatactccaataccactgttgtcaatgtaaataagggcgtagcccaaaagcactgaggccactggcaacctgtagctttcctataaaaaatccttaacccagtaacccgcggatgggccaaatgcattcagtcggtagcggcaactgctttgctaaaagtagaaaagtaacttttagaggaaaccttcttgtgagcacacctcaccagttacattattctaagttaaaaaaaaagcaaaaaggtagcttactaaatcaaaaatcttaaagtatggggctattatgttagaaaagggtaatgtaactccaaccactgataattcacttaacccagcagatttcctaacaaaggatttaaatcttaattaccatacaaaggtccgaccagacctaggaggaactcccttcaggacaggacgatagatggttcctcccaggtgattgagggaaaaaaccacaataggtattcagtaattaatacagagactctgtggaagcagagttagaaaaattgcctaataattggtctcctcaaacgtgcgagctgtttgcactcagccaagcccatacttacataatcaaaagactatttcaatcctgactcaaaaggttcgctacacctctctgaaacgaatttgcataagagtgttgtttatgggaatgcatcttgatggggcagctgggttgttatgaaatacccaggaacccagcccagctctaggactcacccctgagcgcaaaagcaatgtcgggcacgctggtaaaggaccactagaatccagcagcccagacccctttctttgtggtcaagagaggtggaaaaataggtgcaggactgctacattggtgagcgtaactaatccgataagcagaggtccatgggtggttacgcaccctggaaaagaataagcattaggcccttagaggatgctttaggactaatgctcatcggaaaatgactaggggtgctggcatccctatgttcttttttcagatcggaaacgttccccacaccccaaggcaaaaacgcccttaagatgtattctggagaataaggaccaatttgaccctcagacgctaagaaagaaatgacttatattcttctgcagtactgcctggccatgatatcctcttcaagggggagaaacctggcctcttgagggaagtataaattataacaccatcttacagcttgacctcttctgtagaaaggagggcaaatggagtgaagtgccatatgtgcaaacttccttttcattaagagacaactcgcaattatgtaaaaagtgtggtttatgccctacaggaagccctcagagtctgcctccctatctcagcatccccccgactccttctgcaactaataagggaccccccttttacccaaaggtccaaagaagatagacaaagggataaacaatgaaccaaacagtgccaatattccccgattatgccccctccaagcaatgtgaggagcagaattcggcccagccagagtgcatgtacctttttctctctcagacttaaagcaaattaaaatagacctaggtaaattctcagataaccctgatggctatactgaagttttataagggttaggacaatcttttgatctgatgtggagagatataatgttactgctaaatcagacactaaccccaaatgagagaagtgtcgccataactgcagcccgaagagtttggtgatctctggtatctcagtcaggtcaatgataggatgacaacagaggaaagagaacaattccccacaggccagcaggcagttcccagtgtagaccctcattgggacacagaatcagaacatggaaattggtgccgcagacatttgctaacttgtgtgctaggactaaggaaaactaggaagaagcctatgaattatgcaatgatgtccactataacacagggaaaggaagaaaatcctactgcctttctggtgagactaagggaggcattgaggaagcatacctctctgtcacctgactctattgaaggccaactaatcttaaaggataagtttatcactcagtcaactgcagacattagaaaaaaacttcaaaagtccgccttaggcccagagcaaaacttagaccctattgaacttggcaacctcggttttttataatacagatcaggagaagcaggcggaatgggacaaacgggataaaaaaaaaggccactgctttagtcatggccctcaggcaagcggactttggagtctctggaaaagggaaaagctgggcaaatcgaatgcctaatatggcttgcttccagtgtggtctacaaggacactttaaaaaagattgtccaagtagaagtaagctgccccctcgtccatgccccttatgtcaagggaatcactggaaggcccattgccccaggggacgaaggtcctctgagtcagaagccactaaccagatgatccagcagcaggactgagggtgcccggggcaagcaccagcccatgccatcaccctcacagggccccgggtatgcttgaacattgaaggccaggaggttaactgtctcctggacactggcatggccttctcagtcttactctcctgtcccagacaactgtcctccagatctgtcactatccgaggggtcctaggacagccactaagttgtgactggggaactttactcttttcacatgcttttctaattatgcctgaaagccccactcccttgttagggggagacattctagcaaaagcaggggccattatatatctgaacataggagaaggaacacctgtttgttttcccctgcttgaggaaggaattaatcctgacgtctgggcaacagaaggacaatatggatgagcaaagaatgcctgtcctattcaagttaaattaaaggattctacctcctttccctaccaaaggcagtacccttagacctgaggcccaacaaggactccaaaagattgttaaggacttaaaagcccaaggcctagtaaaaccatgcaatagcccctgcaatactccagttttaggagtacagaaacctaatggacagtggaggttagtgcaagatctcaggattatcaatgaggctgttcttcctctataccctgctatacctaacccttgtactctgctttcccaaaaaccacagaaagcagagtggtttacagtcctggaccttaaggatgcctttttctgcatccctgtacaccctgactctcaattcttgtttgcctttgaagatcctttgaacccaatgtctcaactcacctggactgttttaccccaagggttcaagcatagcgcccatctatttggccaggcattagcccaagacttgagccaattctcatacctggacactcttgtccttcagtacggggatgatttaattttagccacccgatcagaaacctggtgccatcaagccacccaagcactcttaaatttccttgctacctgtggctacaaggtttccaaacaaaatgctcagctctgctcacagcaggttaaaaacttagggctaaaattatccaaaggcacaagggccctcagtgaggaacgtatccagcctatactggcttatcctcatcccaaaaccctaaagcaactaagagggttccttggcataacaagcttctgccgaatatggattcccaggtacagcgaaatagtcaggccattatacacactaaggaaactcagaaagccaatacccatttagtaagatggacacctgaagcagaagtggcttttcaggccctaaagaaggccctaacccaagccccagtggtaagcttgccaatggggcaagacttttctttatatgtcgcaaaagaaacaggaatagctctaggagtccttatacaggtccgagggaccagcttgcaacctgtggcatacctgagtaaggaaattgatgtactggcaaagggttggcctcattgtttacgggtagtggcaacagtagcagtcttagtatctgaagcagttaaagtaatacagggaagagatcttactgtgtgaacatctcatgatgtgaatggcatactcactgctaaaggagacttgtggctgtcagacaaccgtttacttaaatatcaggctctattacttgatgggccagtggtgtgactgcgcacttgtgcaactcttaacacagccacatttcttccagacaatgaagaaaagatagaacataaatgccaacatgtgattgctcaaacctaatgctgctcaaggggaccttttaggggttcccttgactgatcccaacctcaacttgtatactgatggaagttcctttgcagaaaaaggactttgaaaagcggggtatgcagtggtcagtgataatggaatacttgaaactaatcccctcactccaggaactagtgctcagcatgcagaactaatagccctcactcgggcactagaattaggagaagggaaaagggtaaatatatatacagactctaagtacgcttacctagtcctccatgcccatgcagcaatatggagagaggggaattcctaacttccgagggaacacctatcaaacatcaggaagccattaggagattactattggctgtacagaaacctaaagaggtggcagtcttacactgccagagtcaccagaaaggaaagggaaacagaaaggaactgccaagcggatattgaagccaaaagagcggcaaggcaggaccctctattagaaatgcttatagaaggacccccagt

SEQ ID NO: 186 - DNA, 717 bp, Homo sapiens
ttacagtgggtagctaatgaggcatgaacagggcagaagagggctccccacaccccaccagggatgtaaggcaaccatcaggtgatggtcaggcagttgtcatgtgtctctctaaaataataattggtaacagctggtgccagggaagggccatctcccaatagaaacacctgaaactggtgatcagtagcttcctgataagatctcaggaggtgggtgagtgggcccaagcacgcacattaagaggaaacatggtggagtttaactggtatatgaacttggagggacattcgacaggtaagggaagaatacctcaagtgagcctgtgtacaactacagtaaacacactgcacatgcttacctcccaagtgctggcaggccactgcacatgcagacagcccaccccaggggaagaatcaggggagaagggatgccagaccccaaaagtatgccaacatataaaaccccaagttaaaaggtcaaacagtgcccttgactctctcaagtcacctgcttggccctcttccaagtgtacttcacttccttgcattcctgctcgaaagctttttgataaactttcactccttctgtaaaaacttgcctcagtctctccttctgtcttatgcccctcagttgaattgtttcttctgaggaggcaagaattgaggttgccacagacccacacagattcgttgctggtaacatactttagtgcca

SEQ ID NO: 187 - DNA, 5648 bp, Homo sapiens
gtcaggcctctgagctaagccatcatatctcctgtgacctgcacgtatacatccagatggcctgaagtaactgaaaaatgacaaaagaagtgaaaatggcccgttcctaccttaacagatgacattaccttgtgaaattctcctggctcatcctggctcaaaagctcccccactgagcacctggtgacctccacccctgccagccagagaacaaccccctttgactgtaattttccactacctacccaaatgttataaaatggccccaccccatctccctttgctgactctcttttcggactcagcccgcctgcacccaggtgattaaaaagctttattgctcaccaggtttggtggtcttttcacatggacaggagtgaaatttggtgctgtgacttggatcgggggaccttccttgggagatcaatcccctgtcctcctgctctttgctctgtgagaaagatccacctacgacctctggtcctcagactaaccagcccaaggaacatctcaccaattttaaatccagtaagcagcctctccttactctcttctccagcctctctcactatccctcaacctctttctcctttcaatcttggtgccacacttcaatctctcccttctcttaatttcagttcctttccttttctggtagagacaaaggaaatgtgttttatccatggacccaaaactccggcgccggtcacggactccagaagacagtcttctgttggtgtttaatcacgtggggatgcctgcctgattattcacccacgtttcagaggtgtctgaccacgcagggacgcctgccttggtccttcactcttagcggcaagcaccacttttctggggggcaagcaccctctgaccccttctctctgtgtctctaccccttcgccactttccaggggggcaagtaccccccaccccttctctccatgtctctactcttctctttaaacttgcctccttcactgtgggcaaccttccaccctccattcctccttcttctcccttagcttgtgttctcaagaacttaaaacctcttcaactcttgcctgacctaaaatctaagcatcttattttcttctgcaacactgcttgaccccagtacaaactcaacagtggttccaaatagccagaaaatggaactttcgatttttctatcctacaagatctagataattcttgtcataaaatgggcaaacaatctgagatgcctgacatccaggcattttttacacatttttccctccctagtctctgttcccaatgagacttgtcccaaatcctccttctttccctcctgcctgtcccctcagtcccaaccccaagtgtcactgagtctttctaatcttccttttctacagacccatctgacctctcccctcctccccaggctgctccttgccaggccgagctaggtcccaattcttcctcagcctccactcctccaccctgtaatccttttgtcacctcccctcctcacacccggtccagcttacagtttcattctgcaaatagccctcccccacctgcccagcaatttcctcttaaaaaggtagctgtagctaaaggcatagtcaaggttaatgctcctttttgtttatctgacctttcccaaatcagttagcatctaggctctttttcacaaaatatgaaaacctagcccagttcatggcttgtttgttagcaaccctgagatgctttacagccccagacccttaaaggtcaaaaggccatcttattctcaatatacattttattacccaatctgctcctgacattaaataaaactccaaaaattaaattccggccctcaaaccccacaacaggacttaattaaccttgccttcaaggtgtataataatagagtagaggcagccaagtagcaatgtgtttctgagttgcaattccttgcctccactgtgagacaaatcccagccacatctccagcacgcaagaacttccaaacgcctgaactgctgcaaccagacgttcttccagggcctcctcccccaggaacttgcttcaagtgctgaaaatactgggccaaggaatgctcacagcctgggattcctcctaagccatgtcccatctgtatgggtccccactggaaatcagactgtccaacctggcagccactcccagaacccctggaactctgccccaaggctgtctgactgactccttcccagatctactcggcttagcggctaaagactgatgctgcccaatcacctcggaagtctacaggaccatcacagacgctttgggtaactcttacattggagggtaagtccatccccttcttaatcaatagggaggctactcacatcacattaccttcttttcaagggcctgtttcctttgcctccataactgttgtgggtattgatggccaggcttctaaacctcttaaaactccgcaactctggtgccaacttaaacaatactcttttaagcactcctttttagttgttgccacctgcccagctcccttattaagttgagacattttaactaaattgtctgcttccctgactattcctgggctacagccacacctcatggctgccttttcctccaattcaaagcctcctttgcatcctccccttgtatctcccaaccttaaaccacaagtataggatgcctctactccccccttggcgacaaatcatgcaccccttaccatcccattaaaacctaatcacccttgcctgctcaatgccaatatcccatcccacagcacgctttaaaaggattaaagcctgttatcacttgcctgttacagcatggccttttaaagcctataaactctccttatgactcccccattttacctgtccaaaaaccagacaagccttacaggttagttcaggatctgcaccttataatccaaattgtttttgcctatccaccccatggtgccaaagccatatactctcctatcctcaatacctccctccacaacccattattctgttctggatctcaaatatgctttctttactattcctttgcacccttcatcccagcctctcttcaatttcacttggactgaccctgacacccatcaggctcagcaaattacctgggcagtactgcaacaaggcttcacagacagcccccattacttcagttaagcccaaatttcttcctcatctgttacttatctcagcataattctcataaaaacacacatgctctccctgctgatcgtgtccgactaatctcccaaaccccaatctcttctataaaacaacaactcctttccttcctaggcatggttagtgcggtcagaattcttacacaagagccgggaccacaccctgtagcttttctgtccaaacaacttgaccttactcttttagcctagccctcatgtctacatgcagtggctgccgatgctttaatacttttagaggccctaaaaatcacaaactatgctcaactcactctctacatttctcataacttccaaaatctattttctttctcccacctgatgcatatactttctgctccccagctccttcagctatactcactctttgttgagtctcccgcaattaccattgttcctggcctggacttcaatctggccttccacgttattcctgataccacacctggtccccatgactgtatctctctaatccacctgacactcactccatttccctatattctttcctgttactcaccatgaacacacttggtttattgatggcagttccaccaggcctaattgccactcaccagcaaaggcaggctgtgctatagtatcttccacatgtatcattgaggctaccactctgccccatccactacctctcagcaagctgaactcattgccttaactcgggccctcactcttgcaatgggactacatgtcaatatttatactgactctaaatatgccttccatatcctgcaccaccatgctgttatatgggctgaaagaggtttcctcactacgcaagcttcgtccattattaatgtctcattaataaaaatgcttctcaaagccactttacgtccaaaggaagctgaagtcattcactgcaaaagccatcaaaaggcatcagatcccatcgctcaggacaacgcttatgctgataaggtagctaaaacttccgcctatcaatctcttcccacacaaggcaaatggttcttggaccagtgaaaatacctccttccagcctcacaggccaattctattctgttgtcatttcagaacctcttccgtgtaggttacaagccactagcctgcctcttagaacctctcatttcctttccattgtggaaatctatccacaaggaaatcacttctcagtgttccatctgctcttctactactcctcagggattgttcaggccccctcccttctctttacatcccctcccttctctgcacatcaagctcagggatttgccccgacccaggactggcaaattgactttactcatatgcctcgagtcaggaaactaaaatacctcttgatctgggtagaccctttcactggatgaatagaggcctttcccacagggtctgggaaggccaccatggtcatttcttcccttctgtcagacacaattcctcagtttggccttcccgcctctatatagtctgataacggactggtctttactagtcaaatcacccaagcagtttctcaggctcttggtattcagtagaaccttcctatcccttacggtcctcaatcttcaggaaaggtaaaacggactaatggtcttttaaaaacacacgtcaccaagctcagcctccaacttaaaaaaaggactctgtcaagaatagagctaaaaaaactcaccaagcaagcaagtaattacactgaacccccttggacactctctaattggatgtcctggatcctcccaattcttagtcctttaatacctgtttttctccttctcttattctgaccttgtgtattccatttagtttttcaattcatacaaaaccgtatccaggccatcatcagtaattctatacgataaatgtttcttctaacaaccccgcaatatcaccccttactacagaatcttccttcagcttaatctctcccactctaagttcccatgccaccccaatcccgctcgaagcagccctaagaaacattgctcattatctctccataccactccccaaaatttttgccaccccaactgtttaccactattttgttttattttttcttattaatataagaagacaggaatgtcaggcctctgagcccaagctaagccatcatatcccctgtgacctgcacgtatacatccagatggcctgaagtaactgaagaatgacaaaagaagtgaaaatggcctgttcctgccgtaactgatgacattaccttgtgaaattccttctcctggcttatcctggctcaaaagctcccctactgagcaccttgtgactcctacccctgccagtcagagaacaaccccctttgactgtaatctcccactacctacccaaatcttataaaacggctccaccccatctccctttgctgactctgttttcagactcagcccacctgcacccaggtgattaaaaagctttattgcccacacaaagcctgtttggtgttgtcttcacatggataggagtgaaa

SEQ ID NO: 188 - DNA, 5642 bp, Homo sapiens
gtcaggcttctgagcccaagctaagccatcgtatcccctgtgacctgcacatacacatccagatggccggttactgccttaactgatgacattcctccaaaaaagaagtgaaaatggcctgttcctgccttaactgatgacattatcttgtgaaattccttctcctgggtcaaaagctcccttactgagcaccttgtgacccccacccctgcccgccagagaacaacccctttgactgtaattttcctttacctacccaaatcctataaaacggccccacccctatctcccttcactgactctcttttcggactcagcccgcctgcacccaggtgaaataaacagccttgttgctcacacaaagcctgtttggtggtctcttcacatggtcgcgcatgaaatttggtgccgtcactcagatcaggggacctcccttgggagatcaatcccctgtcctcctgctctttgctccatgagaaagatccacctatgacctcaggtcctcagaccgaccagcccaaggaacatctcaccaatttcaaatccagtaagcggcctctttttactctcttctccaccctctctcactatccctcaacctctttctcctttcaatcttggcaccacacttccatctctcccatctcttattttcaattcctttcattttctggtagagacaaaagagacacattttttccgtggacccaaaactccggcgccagtcacagactcaggaaggcagccttcccttggtgtttaatcattgtggggacacctctctgattattcacccacgttccactggtgtctgatctccacggagacgcctgccttgatcattcacccacgttcccttggtggcaagtcaattgcggggacgcctgctttggctgctcaaccacgttgcagcccagggctgctccccaccaccttctctgtgtctctatccttctctttaaacttgcctcctttactatgggcaaccttccaccctccattcccccttcttctcccttagcctgtgttcttaaaaacctaaaacctcttcacctcacacctgacctgaaacctaaatgccttatttttttctgcaatgctgcttgaccccaatacaaactcaacagtggttccaaatagccagaaaatggcactttcaattattccatcctacaaggtctaaataattcttgtcgtaaaatgggcaaacggtctgaaatgcctgacgtccaggcattcttttacacatcggtccctccctagtctctgttcccaatacaactcgtcccaaatcttccttctttccctcctgcctgtcccctcagtcccaaccccaagcgtcgctgagtctttctaatcttccttttctacagacccatctgacctctcccctcctcgccaggctgagctaggtcccacttcttcctcagcctccgctcctccaccctataatcattttatcacctcccttcctcacacccggtccagcttacagttttgttctgtgactagccctcccccacctgcccagcaatttactcttaaaaaggtggctggagctaaaggcgtagtcaaagttaatgctcctttttctttatcccaaatcagatagcatttagactctttctcatcaaatataaaaacccagcccagttcatggcagcaaccctgagatgctttacagccctagatcctaaaaggtcaaaaggccgtcttattctcaatatacattttattacccaatctgctcccgacatttaataaaactccaaaaattaaattccggccctcaaaccccacaacaggacttaattaaccttgccttcaaggtgtacaacaatagagtagaggcagccaagtagcaacatatttctgagttgcaattccttgcctccaccgtgagacaaaccccagccacatctccagcacacaagaacttccaaatgcctcaaccacagtggccaggcattcctccaggcctgcctcccctaggagcttgctacaagtgccagaaatctggccaccaggccaaggaatgtccacagcccaggattcctcctaagccgcgtcccatctgtgtgggaccccactgaaaatcggactgttcaactcacctggcagccactcccagagcccctggaactctggcccaaggctctctgactgactccttcccagatcttcttggcttagcggctgaagactgatgctgcccgatcgcctcagaagccccgtagaccatgatggacaccgagctttaggtaactctcacagtggaagataagtccgtccccttcttaatcaatacggaggctacccactccacgttaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggccgagacactttaactaaatgatctgcttccctgactattcctggactatagctacatctcattgctgcccttcttcccaatccaaagcctcctttgtgtcctcctcttgtatccccccaccttaacccacaagtataggatacctctactccctccttggtgaccgatcatgcaccccttaccatctcattaaaacctaatcacccttaccccgctcaatgccaatatcccatcccacagcacgctttaaaaggattaaagcctgttatcactcgcctgctacagcatggccttttaaagcctataaactctccttacaattcccccattttacctgtcctagaaccagacaagccttacaggttagttcaggatctgcgccttatcaaccaaattgttttgcctatccaccccgtggtgccgaacccatacactctcctatcctcaatacctccctccacaacccattattctgttctggatctcaaacatgctttctttactattcctttgcacccttcatcccagcctgtcttcgctttcacttggactgaccctgacacccatcaggctcagcaaattacctgggctgtactgcctcaagtcttcacagacagcccccattacttcagtcaagcccaaatttcttcctcatctgttacctatctcagcgtaattctcataaaaacacacgtgctctccctgctgatcatgttcagctgatctctcaaaccccgagaactacaaaacaacaactcctttccttcctaggcatggttggatactttcgactttagatagctggttttgccatcctaacaaaaccattatataaactcacaaaaagaaacctagctgaccccatagatcctaaatcctttccccactcctctttccattccttgaagacagctttagaggctgcccccaccctagctctccctgatttatcccaacccttttcattacacacagctgaagtgcagggctgtgcagtcaggattcttacataaggaccgggatcatgtcctgtagcctttttatccaaacaacttgaccttactgttttgcccagccctcaagtctgcgtgcagcggccgccgctgccctaatacttttagaggcccttaaaatcacaaactatgctcaactcactctctgcagttctcataacttccaaaatctattttcttcctcacacctgacacatactttctgctccccggctccttcagctgtactcactctttgttaagtctcccacaattaccatcgttcctggcccggacttcaatccagcctcccacattattcctgataccacacctgacccccatgactctatctctctgatccacctgacattcaccccatttccccatatttccttcttccctgtttctcaccctgatcacacttggtttattgatggcagttccaccaggcctaatcgccacacaccagcaaaggcaggctatgctatagtacaagccactagcccacctcttagaacctctcatttcctttccatggtggaaatctatcctcaaggaaataacttctcagtgttccatctgctattctactactcctcagggattattcaggcccccttccttccctacacatcaagctcggagatttgcccccatccaggactggcagattggctttactcaacatgccccgagtcagataactaaaatacctcttagtctaagtagacattttcactggatgggtagaggcctttcctacagggtctgaggaggccaccacagtcatttcttcccttctgtcagacataattcctctgttcagccttcccacctctatccagtctgataacagaccagcctttattagtcaaatcagccaagcagtttttcaggctcttggtattcagtgaaacgtttatatcccttacagtcctcagttttcaggaaaagtagaacagactaatggtcttttaaaaacacacctcaccaagctcagccaccaacttaaaaaggaatggacgatacttttaccactttcccttctcagaattcaggcctgacctcagaatgctagaaggtacagcccatttgagctcccgtatagacgctcctttttattaggccccagtctcatcccagacaccagaccaacttagactgtgcccccaaaatcttgtcatctctactattttctgtctagtcatactcctattcaccagtttcaactactcataaatgccctgctcttgtttacactgccagtttacactgtttctccaatctatcacagctgatatctcctggtgctatccccaaaccgccactcttaaagtgaataaataatctttgctggcaaggctatgctgaacctccttaggcactctctaattagatgtcctaggtcctcccaattcttagtcctttaatacctgtttttctccttctcttgttctgtttagtttttcaattcatacaaaactgtatccaggccatcaccaataattctacacaacaaatgtttcttctaacaaccccacaatatcaccccttaccacaaaatcttccttcagcttaatctctcccactctaggttcccacgcctcccctaatcccgcttgaagcagccttgagaaacatcgcccattctctctccataccacccccaaaaattttcgccgccccaacactttaccactatttctttttatttttctcattaatataagaagacaggaatgtcaggcctctgagcccaagctaagccatcatatcccctgtgacctgcacatacacatccagatggctggttcctgccttaactgatgacattccaccacaaaagaagtgaaaatggcctgttcctgccttaactgatgacattctcttgtgaaattccttctcctggctcatcctggatcaaaagctcccctactgagcaccttgtgacccccactcctgcctgccagataacaacccctttgactgtaattttcctttatctacccaaatcctgtaaaacagccccacccctatctcccttcactgactctcttttcggactcagcccacctgcacccaggtgaaataaacagccttgttgctcacacaaagcctgtttggtggtctcttcacacggacgtgcatgaaa

SEQ ID NO: 189 - DNA, 447 bp, Homo sapiens
gtcaggcctctgagcccaagccaagccattgcatcccctgtgacttgcacgtatacgcccagatggcctaaagcaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaccaccccaactgagcaccttgtgacccccactcctgcccgccagagaacaaaccccctttgactgtaattttcctttacctacccaaatcctataaaatggccccacccttatctcccttcactgactctcttttcggactcagcccacctgcacccaggtgaaatagccatgttgctcacacaaagcctatttggtggtctcttcacacggacgagcatgaaa

SEQ ID NO: 190 - DNA, 8823 bp, Homo sapiens
atggtatgagaccaccacttctcctgttgtcttttttagtttctccccaacctccccttttccctagtttataagacaggagaaaagggagaaagcaaaaagttggaaagaaacagaagtaagataaatagctagacgaccttggtgccaccacctggccctggtggttgaaataataataatattaacccctgaccaaaactactggtgctatctgtaaattccagacattgtatgagaaagcactgtaaaactttttgttctgttagctgatgtatgtagcccccagtcacgttcctcatgcttgcttgatccattatgactctttcacgtagaccccttagagttgtaagcccttaaaagggccaggaatttcttttttggggagctgggctcttaagacacgagtctgccgatgctcccagctgaataaagaaacctcttccttctttaattcggtgtctgaggagttttgtctgcgactcgtcctgctacatttcttggttccctgactgggaagcgaggtaattgatagacagtcgaggcagccccttaggcggcttaggcctgccctgtggagcatccctgcaggggactctagccagcttgagcgacgcggatcctgagagcgctcccaggtaggcaattgcctcggtggaatgcctcgtcagagcagtgtgtggcaggcccccgtggaggatcaacgcagtggctgaacaccgggaaggaactggcacttggagtctggacatttgaaacttggtaagactggtctttggaacttgcccactccatttgagtggaagcgtggcctgagcacccatggtgtgcctgtactggcactttggtttttgtttttgacttgacttaaattgcttgatactttggttttggtttgacctggcttggatttctggatactctgattttggttttgattctggtttggtgaaaactgaaaaagtgtgtgtgtgccctttttacctattctttgttctgtggtgtgcgtgtggtgtgagctcggtgttttgtcttaaggaaacatgggtcagacacaaagtaagcttactccgctaggaactatgttgaaaaattttaagaagggatttaatggagactatggggttactatgacaccaggaaaacttagaactttgtgtgaaatagattggccaacattagaagtggattggccatcagaaggaagcctggacaggtcccttgtttctaaggtatggcacaaggtaactggtaagtcaggacactcagaccagtttccatacatagacacttggttacatctggtagaccccccgcagtggctaagagggcaggcagcagcagtgctagtagcaaagggacagatagccaaggaaggatcccgctccacccgccgagggaaatcaactcctgaagttctgttcgacccaacatcagaagatccattgcaggagatggcaccagtgatcccagtggtgccctcccgttaccagggagagaggctcaccacttttgagtccacggggcttgcacctccacaagacaaacatccctaggccacccagagtaggcaagagaggaggtgaagcctcgggagaaacccctcccttggcagctggtttaagacccaaaacggggatacaaatgcccctgagagagcagtggtatactggaatagatgaggatgggcacatggtggagaggcgtgtttttgtgtaccagcccttcttctctgccgacctcctcaactggaaaaacaataccccatcctatactgaaaagccgcaagctctaattgatttgctccaaactattatccagacccataaccccacttgggctgattgccaccagttgctcatgttcctctttaacacagatgaaaggcggagagtgctccaagcagcaactaagtggctagaggaacatgcaccggctgattaccaaaacccccaagagtatgtaaggacccagttaccgggaaccgacccccagtgggacccaaatgaaagagaggatatgcaaaggctaaaccgatacagggaagctctcttggaaggattaaagaggggagcccagaaggccacaaacgtggccattcagggaaaagaagaaagtccagcacaattctacgagaggctgtgtgaggcctattgtatgtatactccctttgatcccaatagtcctgaaaatcagcgcatgattaacatggctttagttagtcaaagtgcagaagacattagaagaaaactgcagaaacaggctgggtttgcagggatgaacacatcacagttattagaaatagctaaccaggtgtttgtaaacagggatgcagtaagccctaaggaaaaccgcagagagaatgaacatcaggtccggcgaaatgccgacctgttagctgcagcaatcacaggggtccccccaaagaggcaagggaaggggggccccgggaaagaaattcagcctggttgtcagagcttgcagcgtaatcagtgtgcttattgtaaagaaataggacattggaagaacaaatgccctcagctaaaaggaaaacaaggtgactcggagcaggaggatccagacaaggaggaaggggccctgctcaacctggcagaaaggttattggactgagggggaccgggctcaaggacccccaaagagcctatggtcaggatgacagttgggggtaaagacattgattttcttgtagataccggtgctgaacattcggtagtaaccaccccggtcagccccttatccaaaaagactattgacataattggagccacaggagtttcagcaaaacaagctttctgcttgccccggacttgtactgtaggaggacataaagtgattcatcagtttttgtacatgcctgattgtcccttgcccttgttgggaagggacttgcttagcaaactgagagccactatctattttacagagcatggctctttgctgctaaagttacccggaacgggagtcattatgacccttatggtaccccgagaggaggaatggaaacttttcttaactgagtcgggccaagagataagaccagctctggctaagtggtggccaagagtgtgggcagaagacaaccctccagggttggcagtcaaccaagcccccgtacttatagaagttaagcctagggcccagccggttaggcaaaaacagtacccggtccccagagaagctcttcaaggtatccaggtccatctcaagtgcctaagaacctttggaattatagttccttgtcagtctccatggaacactcccctcctgcctgttcccaagcctgggaccaaggactacaggccggtacaggatttgcgcttggttaatcaggctacagtgactttacacccaacagtacctaactggtacacattgctggggttgctgccagctgaggacagctggttcacctgcttggacctgaaagatgctttctttagcatcagattagcccctgagagccagaagctgtttgcctttcagtgggaagatccggagtcaggtgtcactactcagtacacttggatccggcttcccaaagggttcaagaactcccccaccatcttcggggaggcattggctcaagacctccagaagtttcccaccagagacctaggctgcatgttgctccagtacgttgatgacctttttctgggacaccctacggcagtcaggtgcgccaagggaacagatgctctactccggcacctggaggactgtgggtataaggtgttcaagaaaaaagttcagatctgccgacagcaggtacgttacttgggatttactatccggcagggggagtgcagcctgggatcaaaaagaaagcaagtcatttgtaatctaccggagcctaagaccagaaggcaggtgagagaattcttaggggcagtggggttttgcagactgtgggtcccaaactttgcagtattagctaagcctttgtatgaggtcacaaaggtgggggactgggaacattttgaatggggatcccagtaacagcaagcctttcatgagttaaaggaaagacttatgtcagccccagccctggggctacccgatctgacaaagccttttatattatatgtgtcagagaaagaaaagatggcagttggagttttaacccatactgtggggccctggccgaggccagtggcctacctctctaaacaactagatggggtttctaaaggatgacccccatgtttgagggccttggcagcaactgccctgctagtacaagaagcagataagctgactcttgggcaaaacctgaacataaaggccccccatactgtggtgactttaatgaatactaaaggacatcattggctaatgaatgctagactcactaagtaccaaagtttgctctgtgaaaatccccatataaccattgaagtttgtaacaccctgaaccccgctaccttgctcctggtatcagagagccctgtcaagcatgactgtgtagaagtgttggactcagtttactctagcagacctgacctccgggaccagccttgggcatcagtagactgggtactatacgtggatgggagcagcttcatcaacccacaaggagagagatgtgcagggtatgcggtggtaactctggacactgttgttgaagcccgatcgttgccccagggcacttcagctcagaaaactgaactcattgctttaatttgggccttagaactcagtgaaggtaagactgtaaacatttacactgactgtcgatatgcctttttaacccttcaagtgcatggagcattatataaagaaaagggtctattgaactctgggggaaaggacataaaatatcaacaagaaatcttgcaattattagaagcagtatagaaaccacacaaggtggcagttatgcattgcagaggacaccagtgggcttccaccttggtgggtttggggaattcccacgctgacttagaggctcgaaaagcagcatctgcccccttccgggcatcagtcacagcccccctgctccctcaagcacctgatcttgtacctacttattctaaagaagaaaatgactttctccaggcagagggaggacaagtgatggaggaaggattgattcggttaccagatgggagagtagctgtgccacagctgctaggagctgcagttgtactggctgtccatgaaaccacccatctaggtcaggaatcacttgaaaagttgttaggctggtatttctacatctcgcatttgtcagcccttgccaaaacggtgacccagcggtgtgttacctgccgacagcataatgcgaggcaaggtctagctgttccacctggcatacaagcttatggagaagccccctttgaagatctggatccaggtggacttcacagagatgccaaagtgtggaggtaacaagtatttactagttcttgtgtgtacctactctgggtgggtggaggcttatccaacacgaactgagaaagctcgtgaagtaactcgtgtgcttctttgagatcttattcctagatttggactgcctttatggatcggctcagataacgggccggcatttgtggctgacttggtacagaagatggcaaaggtattggggatcacatggaaactgcatgctgcctaccggcctcagagttccggaaaggtggagcagatgaatcggactatcaaaaatagtttagggaaagtatgtcaggaaacaggattaaaatggatacaggctctccctatggtattatttaaaattagatataccccttctaaaagaacaggatattccccttatgaaatattatatcataggccccctcctatattgcggggacttccaggcactccctgagagttaggtgaaattgagttacagtgacagctacaggctttaggaaaaattacacaaacaatctcagcctgggtaaatgagaaatgccctgttagcttattctccccagttcaccctttctccccaggtgatcgagtgtggatcaaggactggaacgtagcctttttgtgtccacggtggaaaggaccccagactgtcgtcctgaccactcccaccactgtgaaggtagagggaatcccagcctggatccaccacagccatggaaaacctacagcacctgaaacctgggaggcaagaccaagcccagacaacccttgcagagtgaccctgaagaagacgacaagccctgctccagtcacacctggaagctgactggtccacacatggctgaagcatgaggaagctcatcatgggattcatttttcttaaattttggacttatacagtaagggcttcaactgaccttactcaaactggggactgttcccagtgtattcatcaggtcaccgaggtaggacagcaaactaaaacaatctttctgttctatagttattatgaatgtatgggaacattaaaagaaacttgtttgtataatgccactcagtacaaggtatgtagcctgggaaatgactgacctgatgtgtgttataacccatctgagccccttgcaaccatcgtttttaaaataagattaagaaatggccttttcctaggtgatacaaggaaaataataactagaacagaagaaaaaaggaatccccaaacaaataactttaagatgtgatgcttgtgcagccattaatagtaaaaagctaggaataggatgtggttctcttaactgggaaaggagctacagagtagaaaataaatatgtttgtcatgagtcaggggtttatgaaaattgtgcctgttggccatgtgttatttgagctacttggaaaaagaacaaaaaggacccagtttatcttcagaagggggaagccaacccctcctgtgctgccggtcactgtaacccactagaactaataattaccaatcccctagatccccgttggaaaaacggagaacgtgtaaccctggggattgatgggacagggttaaacccccaagttgccattttaattagaggggaggtccccaagcgctctcccaaaccagtatttcaaaccttttatgaggagctgaatctgccagcaccagaacttccaaaaaagacaaaaaatttgtttctccaattagcagaaaatgtagctcattcccttaatgttacttcttgttatgtatgcgggggaaccactatcggagaccgatggccttgggaagcccgagagttggtgcctactgatccagctcctgacataattccagttcagaaggcccaagctagcaacttctgggtcttaaaaacctcaattattggacaatactgtatagctagagaagggaaagactttatcatccctgtaggaaagcttaattgtataggtcagaagttgtataacagcacaacaaagacaattacttgttggggcctaaaccacactgaaaagaagccatttagtaaattttctaagttaaaaactgcttgggctcatccagaatctcatcaggactggatggctcccgctggactatactggatatgtgggcacagagcctatattcggttacctgataaatgggcaggcagttgtgttattggcactattaagctgtgctttttcttattacccataaaaacgggtgagctcctaggtttccccatctatgcctcccaagaaaagagaggcatagttataggaaactggaaagataatgagtggccccctgaaaggatcatacagtattatgggcctgccacatgggcacaagacggctcatggggataccgaacccccatctacatgctcaatcggatcatacggttgcaggccatcttaaaaataattactaatgaaactggcagagctttgactgttttggcttggcaagaaacccaaatgaggaatgctatctatcagaatagactggccttggactacttgctagcagctgaaggaggagtttgtggaaactttaacttaaccaattgctgcctacaaatagatgatcaaggacaggtggttgaaaacatagtcagggacatgacaaaggtggcacatgtgcctgtacagattaaactgtacacgagtttaatcctgagtctttatttggaaaatggtttccagctatgggaggatttaaaaccctcattgtaggtgtattgctagtaataggaacttgcttgctgctcccctgtgtattacccttgctttttcaaataataaaaggttttgttgctattttggttcatcagaaaacttcagcacaggtgtattatatgaatcactatcgctctatctcgcaaagagactcaaaaagtgaggatgagagtgagaactcccactaaaaagtgaaaattctcaaaggggggaaatgtggtatgagaccaccacttctcctgttgtccttcccagtttctcccctacctccccttttccctaatttataagacaggagaaaagggagaaagcaaaaagttggaaagaaacagaagataaatagctagatgaccttggcgccaccacctggccctggtggttaaaataataataatattaacccctgaccaaaactactggtgttatctgtaaattccagacattgtatgagaaagcactgtaaaactttttattctgttagctaatgtatgtagcccccagtcatgttcctcacgcttacttaatctattataactctttcacgtaaaccccttagagttataagcccttaaaagggctaggaatttctttttcggggagctcggctcttaagacatgagtctgctgacgctcccagctgaataaaaaaacctcttccttctttaattcagtgtctgaggagttttgtctgcgactcgtcctgctaca

SEQ ID NO: 191 - DNA, 1443 bp, Homo sapiens
ttagagtaggtatctaggcagacatgaggagggtaggagaggatgccccattcccttccccagtaatgtcaagtgacaaataggtggtggtcaagtggttgttaaactgtctttctgaaataataattggttgtagctggcgccagggaaaggtggtttcccaatagacagaaaacacctgaggctggtgataagcagcttcctgataagatctcaggagttgggtgagtgggctcaagcatgtgcactaagaggcaacatggcagagtttaagtggtatttcttttttgttttgtttttgatggagtcttgctctgtcgcccaggctggagtgcagtggagtgatctcggctcactgcaatctccaactcccaggttcaagggattctcctgcctcagcctcccaagtagctgggattacaggtacacaccacaacgcccagctaattttttttttttatttttagtagagacggagtttcaccatgttggccaggatggtcttgatctcttgacctcatgatctgcctgcctcagcctcccaagtgttgggattacaggtgcgagccaccgcgcccggccccagctagtttttatatttttagtagaggggggtttcaccatgttagccaggctggtcttgaactcctgacctcaagcaatcctcctgccttggcctcccaaagtgttgggattacaggcgtgagccactgcacttggccaacagatctatgtcttcccaggaaccctcagctggtaggggaagaacgcctcaaacgagcatgtgcacaacttcagtaaatatactgttcccaccccaagggaaaatcaagggagaagagacgcaacccccggaaccatgccaatgtataaaaccccaagtcaggggctcaacagtgcacttgaatctctcaagttgcctgcttggccctcttccaagtgtactttacttcctttctttcctctaaaactttttttaaaaatttatattaattaattatttttgagacagagtcttgctgtgtcatccaggctggagtgcagtggtgtgatctcagctcactgcaacctctgcctcctgggttcaagtgattctcctgccttagcctccccagtagctaagattacaggcgcccgacaccacgcctggcaaattttcgtatttttagtagagacggggtttcgccatgttggccaggctggtcttgaactcctggcctcaagcaatccgcccatctcagcctcccaaagtgctgggattataggcatgagctgtcccgtgcccggcctcgttcctgttctaaaactttttaataaactctgactcctgctcaaaaacttgcctcagtctctcactctgccttatgcccctcagaggaattatttccttcgaggaggcaagaattgaattgctgcagacccgtgtggattcgctgctgctaa

SEQ ID NO: 192 - DNA, 966 bp, Homo sapiens
gtggggaaaagagagatcagactgttactgtgtctatgtagaaagaagtagacataagagactccattttgttctgtactaagaaaaattcttttgccttgagatgctgttaatctgtaaccctacccccaaccctgtgcttgcagagacatgtgctgtgtcaactcaaggtttaatggatttagggctatgcagaatgtgctttgttaaacaaatgcttgaaggcagcatgcttgttaaaagtcatcaccactccctactctcaagtacccagggacacaaaacactgtggaaggccacagggacctctgcctaggaaagccaggtattttccaaggtttctccccatgtgatagtctgaaatatggcctcgtgggaagggaaagacctgaccgtcccctagcctgacacccataaagggtctgtgctaggaaggattagtaaaagaggaaggcctctttgcagttgaggtaagaggaaggcatctgtctcctgctcatccctgggcaatggaatgtcttggtgtaaaacccgattgtatattccatctactgagataggaggaaaccgccttagggctgcaggtgagacatgctggtggcaatactgctctttaaggcattgagatgtttatgtatatgcacatcaaaagcacagcacttttttctttgccttgtttatgatgcagagacatttgttcacatgttttcctgctgaccttctccccactattaccctattgtcctgccacatccctctctccaagatggtagagataatgatcaataaatagtgaggtaactcagagactggtgctggcgcaggtcctccgtatgctgagtgcccatcccctgggcccactttcctttctctatactttgtctctgtgtctcttttgtttctcaagtctctcgttccacctgacgagaaacacccacaggtgtggaggggcaggctaccccttca

SEQ ID NO: 193 - DNA, 1741 bp, Homo sapiens
ctgcacgtatacatccagatagcctgaagaatcacaaaagaagtgaaaaatggccagtttctgccttaactgatgacattaccttgtgaaattccttctcctggctcagaagttccttcactgagcaccttgtgacccctacccctgcccgtaagagaacgaccccctttgactataattttccactgcccacccaaatcccataaaagtgccccaccccatctccctttgctgactccttttatggactcagcctgcctgcacccaggtgattaaaaagctttattgctcacacaaagcctgttggtggtctcttcacacggacacgcatgacatttggtgccgtgactcggatcgggggacctcccttgggagatcaatcccctgtcctcctgctctttgctccatgagaaaaatccacccacaagctcgggtcctcagaccagaccaagaaacacctcaccaattttaaatcgggtaagcggcctctttttactcttctccaacctctctcattatccctcaacctctttctcctttcaatttcggcgccacccttcagtctctcccttcccttaatttcagttcctttccttttccagtagaaacagaggagacgctttttttttttttttttttttttttgagagagttttgctctgtcacccaggctggagtgcagtggtgccatcttggctcactgcaagctccacctcctgggttcccgccattctcctgcctcagcctcccgagtagctgggactacaggcgcccgccaccatgtccggctaatttttttttttgtatttttagtagagacggggtttcactgtgttagccaggatggtctcgatctcctgacctcatgatccacctgcctcggcctcccaaagtgctgggattacaggcgtgagccaccgcgcccggcccgagacacgttttatctgtgaaccaaaaatgccggcgcccgtcatggacttgggaagacaagtcttcccttggtgtttaatcactgcggggatgcctgcctgatcattcacccacattctagaggtgtctgattaccatggggacgcctgccttgatccttcaccttggtggcaagtaccacccccccccccaccggggtggcaagtaccacctcccctgggtggcaagtgcccgcccccacctctgtgtctctaccctctcttttctctgggcttgcctccttcactatgggcaaccttccaccctctattcccccttcttctcccttaacctgtgttctcaaaaacgtaaaacctcttcaactttcgcctgacctaaaacctaagtgtcttattttcttctgcaacaccatttggctccaatacaaaccttgataatggttctaaatagccagaaaacagtgctttcaatttctccatcctacaagatctagataatttttgtcataaaatgggcatagtctgaggtgcctgacatccaggcattcttttacacatttgtccctccctagtctctgctcccaatgtgactcgtcctaaatatttcttctctcctgtctgttccttcagtctccaccccaagctctaagtcctttgaatcctccttttctacggacccatctgacctcttccttcctccccaggctgctcctcgccaggctgagccacgtcccaattcttcctcagcctccgctccccaaccctataatccttctatcatctcccctcctcacacccgctctggcttacag

SEQ ID NO: 194 - DNA, 5730 bp, Homo sapiens
gtcaggcctctgagcccaagctaagccatcatgtctcctgtgacctgcacgtacacatccaggtggctggttcctgccttaactgatggcattccaccacaaaagaagtgaaaatggcctgttcctgccttaactgatgacattgtcttgtgaaattccttctcctggctcatcctgactcaaaagctcccctactgagcaccttgtgaccactactctgcttgccagagaatgacccccctttgactataattttcctttatctacccaaatcttataaaacggccccacccctatctcccttcgctgactctcttttcggactcagcccgcctgcacccaggtgattaaaagctttattgctcacacaaagcctatttggtggtctcttcacacggacgtgcatgaaatttggtgccatgactcggatgggggacctcccttgggagatcaatcccccgtcctcctactctttgttctgtgagaaagatccacctatgatctcaggtcctcagaccaaccagcccaagaaacatctcaccaatttcaaatccggtaagtggcctctttttactctcttctccaacctccctcactatccctcaacctctttctcctttcaatcttggtgccacacttcaatctctcccttctcttaatttcaattcctttcattttctggtagagacaaaggagacacgttttatccatggacacaaaactccggcaccggtcacggactagggaaggcagccttcccttggtgtttaatcattgcagggatgcctctctgattattcacccaggtttcagaggtgtcagaccacgcagggacgcctgccttggtccttcacccttagcggcaagccctgcttttctgggggaggggcaagtaccccaacctcatatctctgcaccccgatcccttatttccgcgctctgacctcttatatctctgtgcccgatcccttatttccgcgctctgacctcttatatctctgtgccccgatcccttatttccacgctttgacctcttatatctctgtgccctgatcccttatttccgcgccccaacctcttatatctctgcaccccaatcccttatttccgtgccccaacctcttatatctctgtaccccaatcccttatttccacaccccgaccttgtatttctgtgccccaaacccttctctgcttttctggagggtaagaacccctgaaccccttccctccgtgtctctactctctcttttctctgggcttgcctccttcactatgggcaactttccaccctccatttctccttcttctcccttagcctgtgttcctaagaacttaaaacctcttcaactctcacctgacctaaaacctaagcatcttattttcttctgcaataccacttgaccccaatacaaactcgacagtagttccaaatagccagaaaatggcactttcaatttttccatcctgcaagatctaaataattcttgttgtaaaataggcaaatggtctgaggtgcctgacatcctggcattcttttacacatcggtccctccctagtgtctgtgcccagcacaactcatcccaaatcttccttctttctctcccgcctgtcccctcagtcccaaccccaagcgtcgctgagtctttctaatcttccttttctacagacccatctgacctctcccctcctccccaggctgctgctcgccaggctgagctaggtcccaattcttcctcagccttctctcctccgctctataatccttttaccacctccccttctcacacccagtctggcttacagtttcgttccgtgactagccctcccccacctgcccagcaatttactcttaaaaaggtggctggagctaaatgcatagtcaaggttaatgctcctttttctttatcccaaatcagatagcgtttaggctgtttttcatcaaatataaaaatctagcccagttcatgactcgtttggcagcaaccctgagacactttacagccctagatcctaaaatgtcaaaaggccgtcttattctcaaaatgcattttattatccaatctgctcccgacattacataaaacttcaaaaattaaattccagccctcaaaccccataagaggatttaattaactttgccttcaaggtgtacaataatagaaaaaagtcgcaattcttgcctccactgtgagacaaaccccagccacatctccagcacacaagaacttccaaacgcctgagctgcattggccaggccttcctccagaacctcctcccccaggagcttgctacaagtgccagaaatctggccaccaggccaaggaatgcctgcagcccaggattcctcctaagccgtgtcccatctgtgcaggaccccactggaaatcagactgtccaactcacctggcagccactcccagagcccctggaactctggcccaaggctctctgactccttcccagatcttcttggcttagcagctgaagactgatgctgcccaatcacctcggaagccccctagaccatcacggatgccgagctttgggtaactctcacagtggaaggtaagtccatccccttcttaatcaatacggaggctacccactccacattaccttcttttcaagtgcctgtttcccttgcctccataactgttgtgggtattgacggccaggcttccaaacctcttaaaactccccaactctggtgccaacttagaccatactcttttaagcactccttttaattatccccacctgcccagttcccttattaggctgagacactttaactaaattatctgcttccctgactattcctggattacagctacatctcattactgcccttcttcccaatccaaaacctcctttgtgtcctcctcttgtattccccaaccttaacccacaactataagatacctctactccctccttggtgaccgatcatgcaccccttaccatctcattaaagcctaatcacccttaccccgctcaatgccaatatcccatcccacagcatgctttgaaaggattaaagcctgttatcactcgcctgctacagcatggccttttaaagcgtataaactcttcttacaattcccccattttacctgtcctaaaaccagacaagccttacaagttagttcaagatctatgccttatcaaccaaattgttttgcctatccaccccatggtgccaaacccatatactctcctaccctcaatacctccctccacaatccattattctgttctggatctcaaacatgctttctttactattcctttgcacccgtcgtcccagcctctctttgctttcacttggactgaccctgacacccatgaggctcagcaaattacctgggctgtactgccacaaagcttcacagacggcccccattacttcagtcaagcctaaatttcttccttatctgttacctatctcagcataattctcataaaaacacatgtgctctccctgctgatcatgtctgattaatctcccaaacctcaatcccttataaaacaacaactcctttccttcctaggcatggttagtgtggtcagaattcttacgcaagagccaggactgcaccctgtagcctttcagtccaaacaacttgaccttactgttttagcctagccatcatgtctccgtgcagtggctgctgccgccctggtacttttagaggccctcaaaatcacaaactatgctcaacttactctctacatttctcatcacttccaaaatctattttcttcctcatacctgacacatatactttctgcttcccagctccttcagctgtactcactctttgttaagtcccacaattaccattgttcctggcccagacttcaatccggcctcccacattattcctgataccagacctgacccccatgaccgtatctctctgatccacctgacattcaccccatttccccatttttccttccttcctgttcctcaccctgatcacacttgatttattgatggcagttccaacaggcctaattgccacacaccagcaaaggcagactatgctatagaacaagccactagcctgccttttagaacctctcatttctttccatcgtggaaatctatcctcaaagaaataacttctcagtgttctatctgctattctactactcctcaggggttattcaggccccctcccttccctacacatcaagctcgaggatttgcccccacccaggactggcaaattagctttactcaataagccccgagtccgataactaaaatacctcttagtctaggtagacactttcactggataggtagaggcctttcctacagggtctgagaaggccaccgcagtcatttcttcccttctgtcagacataattcctcagtttagccttcccacctctatacagtctgataatagaccagactttattagtcaaatcagccaagcagtttttcaggctcttagtattcagtgaaaactttatatcccttacagtcctccatcttcaggaaaagtagaacagactaatggtcttttaaaaacacacctcaccaagctcagccaccaagttaaaaaggactggacaatacttttagcactttcccttcccagaagtcagacctgtcctcagaatgctacagggtacagcccatttgagctcctgtatagacgctccttttcattaggcccaagtctcattccagacaccagaccaacttagactatgccccccaaaaaacttttcatccctactgtcttctgtctagtcatactcctattcactgttctcaactactcatacatgccctgctcttgtttacactgccagtttacactgtttctccaagccatcacagctgatatctcctggtgctatccccaaacttccactcttaactcttgaagtaaataaataatctttgctggcaggactatgttgaatctccttaggcactctgtgatcagatgtcctgggtcctcccaattcttagaccttttatacctgtttttctccttctcttattccatttagtttttccattcatacaaaaccatatccaggccatcaccaataattctacatgacaaatgtttcttctaacaaccccacaatatcatcccttaccacaaaatcttccttcagcttaatctctcccactctaggttcccacgccacccctaatcccgcttgaagcagccctgagaagcatcgcccattatctctccataccatccccaaaaagttttcaccatcccaacactttaccactatttcattttatttttcttattaatataagaagacaggaatgtcagacctctgagcccaagctaagccatcatatcccctatgacctgcacatacacatccagatggctggttcctgccttaactgatgacattccactacaaaagaagtgaaaatggcctgttcctgccttaactgatgacattgtcttatgaaattccttctcctggctcatcctggctcaaaagctcccctactgagcaccttgtgacccctactctgcctgacagagaacaacccccatttgactgtaattttcctttatctacccaaatcttataaaatggccccactcctatctcccttcactgactctcttttcggactcagcccacctgcacccaggtgattaaaagctttattgctcacacaaagcctgtttggtggtctcttcacacggacgtgcatgaaa

SEQ ID NO: 195 - DNA, 4616 bp, Homo sapiens
gtcaggcctctgaggccaagctaagccatcatatcccctgtgacctgcacgtacacatccagatggctgattcctgccttaactgatgacattccaccacaaaagaagttaaaatggcctgttcctgccttaactgatgacattatcttgtgaaattccttctcctggctcatcctggctcaaaagctcccctactgagcaccttgtgacccctactcctgcctgctagagaacaacctgcctttgactgtaattttcctttacctacccaaatcttataaaacggccccacccctgtctcccttcgctgactctcttttcggactcagcctgcctgcacccaggtgattaaaagctttattgtttacacaaagcctgtttggtggtctcttcacatggacgcaagtgagtgaaatttggtgccatgactcagatcaggggaccctccttgggaaatcaaccccctgtcctcctgctctttgctctgtgagaaagatacacctacgacctctggtcctcagacagaccagcccaaggaacatctcaccaatttcaaatccggtaagcggcctctttttactctcttctccaacctccctcactatccctcaacctctttctcctttcaatcttggggccacactgcaatctctcccttctcttaatttcagttcctttcattttctggtagagacaaaggagacacattttatccgtggacccaaaactccggcgccagtcacggacaccggaaggcagccttcccttgttgtttaatcattgtggtgacacctctctgattattcacccatgttccattggtgtctgatctccacggggatgcctgccttgattattcacccacattcccttggtggcaagtcaattgcggggacatctgctttggctgctcacccatgttgcagcccagggctactcctcacccccttctccgtgtctctacccttctccttaaacttgcctccttcactataggcaaacttccaccctccattcctccttcttctcccttagcctgtgttcttaagaacttaaaacctctccaattctcacctgacctaaaatctacgcatcttattttcttctgcaacactgcttgtccacaatacaaacttgacaatggctctaaaaggccagaaaatggcatttttgattatctccatcctacaagacctaaataattcttgtcataaaatgggcaaacggtctgagatgcctgacgtccaggcattcttttacacactggtccctcccgtctctgttcccaatgcaacttatcccaaatcttccttccctcccgcctgtcccctcagtcccaaccccaagtgttactaagtctttctaatcttccttttctacagacccatctgacctctcccctccttgccaggccgagctaggtcccaattcttcccccagcctctgctcctccaccctatgatccttttatcacctcccctcctcgcacccggtccagcttacagttttgttcggtgactagccctccccgacctgcccagcaattccctcttaaaaaggtggctggagctaaaggcatagtcaaggttaatgctcctttttctttatccgacctcttccaaatcagttagtgtttagactctttcatcaaatatgaaaaaccaagcccagttaacggcttgttcggcagcaaccctgagatgctttacagccctaaacactaaaaggtcaaaaggccgtcttattctcaatatatattttattacccaatctgctcctgacattaaataaaactccaaaaattaaattctggccctcaaaccccacaacgggacttaattaacctcgccttcaaggtgtacaatagaagagtagaggcagccaagtaacaatgtatttctgagttgtaattccttgcctccactgtgagacaaaccccagccacatctccagcatgcaagaacttccaaacacccgaaccgcagtggccaggcattcctccagaactgcctcccctaggagcttgctacaagtgccagaaatctggccaccaggccaaggaatgcctgcagcccgggattcctcctaagccgtgtcccatctgtgtgggaccccactggaaatcggactgtccaactcatccggcagccactcccagagcccctggaactctggcccaaggctctctgactgactccttcccagatcttctctacttagcagctgaagactgacactgcttgattgcctcagaagcctacaggaccatcacagacactctgggtaactcttacagtggaaggtaagtccgtccccttcttaatttatatggaggctacccactccatattaccttcttttcaagggcctgtttccctttcaagggcctccataactgttgtgtgtgttgacggccaggcttctaaacctcttaaaactccccaactctggtgccaacctagacaatactcttttaaacactcctttgtggttatccccacctgcccagttcccttattaggctgagatactttaactaaattttctgcttccctgactattcctaggctacagccacgcctctttgtcaccttttcccccagttcaaagcctccttcacatcctccccttgtatctccccaccatagcccacaagtataggacacctctactccctccttggcaactgatcatgcaccccttaccatctcattaaaacctaatcacccttaccccactcaatgccaatatcccatcccacagcatgctttaaaaagattaaagcctgttatcactggcctgttacagtatggccttttaaagcctataaactccccttacagtttccccatttcacctgtcctaaaaccagacaagacttacaggttggttcaggatctgcgccttatcaaccaaattgttttgcctatccaccccttggtgccaaacccatatactctcctatcctcaatacctccctctactacccattattctgttctggatctcaaacatgctttctttactattcctttgcacccttcatcccagcctctcttcactttcacttggactgaccctgacacccatcaggctcagcaaattacctgggctgtactgccacaaagcttcgcagacagcccccattacttcagtcaagtccaaatttcttcctcatctgttacctatctcagcataattctcataaaaatacacgtgcactccctgccgatcgtgtccaactgatctctcaagccccagcaccttctacagaacaacaactcctttccttcctaggcatggttagatactttcaactttagatacctggttttgccatcctaacaaaaccattatataaactcacaaaaggaaacctagctgaccccatagatcctaaatcctttccccactcctctttccattccttgaagacagctttagagactgcccccaccctagctctgcctgactgatcccaaccctattcattacccacagccgaagtgcagggctgtgcagtcagaattcttacacaagaaccaggaccgcaccctgtagcctttttacccaaacaacttgaccttactgttttgcctagccctcaagtctgtgtgcagcagccaccgctgccctaatacttttagaggcccttaaaatcacaaactatgctcaactcactctctacagttctcataacttccaaaatctattttcttcctcacacctgacacatatactttctgctccctggctccttcagctgtactcactctttgttgagtctcccacaattaccattgttcctggcccggacttcaatccagcctcccacattattcctgataccacacctgaccccccatgactgtatctctctgatccacctgacattcaccccatttccccatatttccttctttcctgttcctcaccctgatcacacttggtttattgatggcagttccaccaggcctaatcgccacacaccagcaaaggcaggctatgctacagtacaagccgctagcccgcctcttaaaacctctcatttcctttccatcgtggaaatctatcctcaaggaaataacctctcagtgttccatgtgctattctactgcttctcaaggattattcaggccccctcccttccctacacatcaagctcagagatttgcccctgcccagaactggcaaaatgactttactcacatgccccaattcaggaaactaaaatacctcttggtccgggtagacactttcactggataggtagaggcctttcccacaaggtctaagaaggccaccatggtcatttcttcccttctgtcagacataattcctcggtttggccttcccacctctatacagtccgatagcagaccggcctttattagtcaaatcagccaagcagtttttcaggctcttagtattcagcaaaacctttatataccttacagtcctccgtcttcaggaaaggtagaacaaccaaaagtctttcaaaaacacacctcaccaagctcagccaccaacttaaaaaggactggacaatacttttaccactttcccttcgcagaattcaggcctttcctcagaatgctacagggtacagcccattt

SEQ ID NO: 196 - DNA, 470 bp, Homo sapiens
gagattaaaactgatattggcacccctcctgaggaaatctcaactgcacaacccctactatgccccaattcagcaggaagcagttagagcggtcatcggcaaacctccccaacagcacttgggttttcctgttgagagcggggactgagagacaggactagctggatttcctaggccgactaagaatccctaagcctagctgggaaggtgaccgcatctacctttaaacacggggcttgcaacttagctcacacccaaccgatcagagagctcactaaaatactaattaggcaaaaacaggaggtaaagaaatagccaatcatctattgcctgagagcacagcgggagggacaatgatcaggacataaacccaggcattcgagccagcaacagcaacccactttgggtcccctccctttgtatggaagctctgttttcactctatttcactctattaaatcttgcaactg

SEQ ID NO: 197 - DNA, 714 bp, Homo sapiens
ttacagtaggtagctagtcagacatgagcagggcaggagagtgccaaaccccaccaggaatgtcaggcaaccatcaagtgtggtcaggtggcgttaagctgtctctctaaaataataattggtcacagccagtgccagagaaaagcagtctcccgatagatggaaaaaaacctgaaactggtgatcagcatcttcccaataagatttcaagatttggttgagtgggctcaagcatgtacactaagaggcaaaatggtggagtttaactggtgtgcgaccttctaggaacattgaactggtaagggaagaacgcctcaagtgagcatgcgtgcaactccagtaaacacgctgcacatgcagctccttccaagggctggcaggccactgtgcatgcagagagcccaccctaagggaagaatcaggagaggagagatgcaaactctggaagcatgccaacatttaaagccccaagtcaaaggtcaaactgcgcacttgatctctcaagtcgcctgcttggctctcttccaagtgtactttactcccttttgttcctgctctaaagctttttaataaactttcactcctgctctaaaacttgccttggtctctcactctgccctgtgcccctcggttgaattctttcttgtgaggaagcaagaactgaggttgctgcagacccgtatggattcgccgctgctaacataatttggtacc

SEQ ID NO: 198 - DNA, 705 bp, Homo sapiens
tccacttagtttctcaattcatccaaaaccgtatccaggccatcaccaatcattctatacgacaaatgtttcttctaacatccccacaatatcaccccttaccacaagacctcccttcagcttaatctctcccactctaggttcccacgccgcccctaatcccgcttgaagcagcgctgagaaacatcgcccattctctctccataccacccccaaaaattttcgccgccccaacacttcaacactattttgttttatttttcttattaatataagaaggcaggaatgtcaggcctctgagcccaagccaaaccaagccatcgcatcccctgtgacttgtacgtatacgcccagatggcctgaaataactgaagaatcacaaaagaaatgaatatgccctgccccaccttaactgatgacattccaccacaaaagaagtgtaaatggctggtccttgccttaagtgatgacattaccttgtgaaagtccttttcctagctcatcctggctcaaaaatcacccccactgagcaccttgcaaccccccactcctgcctgccagagaacaaaccccctttgactgtaattttcctttaccttcccaaatcctataaaacggccccacccttatctcccttcgctgactctcttttcagactcagccggcctgcacccaggtgaaataaacagccatgttgctcacaca

SEQ ID NO: 199 - DNA, 990 bp, Homo sapiens
aagaacacgtgagaaagtgtggggaaaagaaagagaaatcagattgttactgtgtctatgtagaaaaggaaacataagaaactccattttgatctgtattaagaaaaattgtttctgctttgagatgctgttaacttgtaactttatccccaaccctgtgctcacagaaacatgtgctgtattggatcaaagtttaatggatttaggactgtgcaggatgtgccttgttaatatgtttgcaggcagtatgcttggtaaaagtcatcgccattctccattctctgttaaccaaggacacaatgcactgtggaaagccacagggacctctgcccaagaaagcctgggtattgtccaacgtttcccccaactgagacagcctgagatatggcctcatgggaaaggaaagaccttaccatcccccagcccgacacccataaagggtctgtgctgaggaggaggagtgaaagagggaggcctctttgcagttgagataagaggaaggcttctctgctcatccctgggaatggaatgtctctgtgtaaagccgaccattcccattcattctattctgagataggagaaaaccgccctgtggctggaggcgagatatgctggcagcaatactgctctgttgctctttgctacactgagatacttgggtaaagagaaacataaatctagccttcgtgcacatccgggcacagtatctttccttgaacttactcatgatacagattcctttgctcacatgtttccctgctgaccttctccccacctgttgccctgctacactccccttgctaagatagtaaagatcatgatcaataaatactgagggaactcagaggctggcgccggtgcgggtccttcgtatgctgagcgccagtgccctgggcccactgttctttctctgtactttgtccctgtgtctatttcttttctcagtctctcatcccacctgacgagaaatacccacaggtgtgaaggggc

SEQ ID NO: 200 - DNA, 5185 bp, Homo sapiens
caggcctctgagccccagctaagccatgatatcccctgtgacctgcacgtacacatccagatggccagttcctgccttaactgatgacattccaccacaaaagaagtgaaaatggcctgttcctgccttaactgatgacactgtcttgtgaaattccttctcctggctcatcctggttcaaaagctcccctgctgaccaccctgtgacccccactcctgcccgccagagaacaaccccctttttcctttacctacccaaatcctataaaacggccccacccctatctcccttcgctgaccctcttttcggactcagcccgcctgcacccaggtgaaataaacagctttattgctcacacaaagcgtgtttggtggtctcttcacatggatgcccatgaaatttggtgccgtgacttggatggggggacatcccttgagagatcaatcccctctcctcttgctctttgctccatgagaaagatccacctctcttttctctgtgcttgcctccttcactatgggcaagcttccaccttccattcctccttcttctcccttagcctgtgttcttaagaacttaaaacctcttcaactctcacctgacctaaaatctaagcatcttattttcttctgcaatgccgcttgaccccaatacaaacaacagtagttccaaatagccggaaaacggcacttccaatttttccattctacaagatctaaataattcttgacgtaaaataggctaacggtcagaggtgcctgacgtccaggcattcttttacacatcggtccctctctagtctctgtttccagtgcaactcatcccaaatcttccttctttccctcccacctgtcccctcagttccaaacccaagtgtcactgaatctttctaatcttccttttctacagacccatctgacctctcccctccttgccaggccgagctaggtctcaattcttcctcagcctctgttcctccaccctataatccttttatcctctcccctcctcacacccggtccgcttacagtttcgttccgcaactagtcctcccccacctgcccagcaatttactcttaaaaaggtggctggagctaaaggcatagtcaaggttaatgctcctttttctttatcccaaatcagatagcgtttaggctcttcttcatcaaatataaaaacccagcccagttcatggcttgtttggcagcaaccctgagatgctttacagccctggaccctaaaaggtcaaaaggccgtcttattctcaatatacattttattacccaatccgctcccgacattaaataaaactccaaaaattaaattccggccctcaaaccccacaacagcacttaattaacctcaccttcaaggtgtacaataatagagtagaggcagccaagtagcaacatatttctgagtcgcaattccttgcctccactgtgagacaaaccccagccacatctccaggacacaagaacttccaaacgcctaaaccgcagtggccaggcatttccccagaaccgactcccccaggagcttgctacaagtgtcagaaatctggccacaagccaatgaatgcccgcagcctgggattcctcctaagctgcatcccatctgtgtgggaccccactggaaatcggactgttcaactcacctggcagccactcccagagcccctggaacgctggcccaaggttctctgactgactccttcccagatcttcacggcttagcagctgaagactgacactgcccgatcgattgcctcagaagcctacaggaccatcacagatgctctaggtaactctcacagtggagggtaagtccgtccccctcttaatcaatacggaggctacccactccacattaccttcttttcaaggacctgtttcccttgcctccataactgttgtgggtattgacagccaggcttctaaacctcttaaaactccccatctctggtgccaacttagacaatactcttttaagcaatccttttagttatccccacctggccagttcccttattaggccgagacactttaactaaattatctgcttccctgactattcctggactacagctacatctcattaccgaccttcttcccaatccaaagcctcctttgcatcctcctcttgtatccccctaccttaacccacaagtataagatacctctactccctccttggctaccgatcatgcaccccttaccatctcattaaaacctaatcaccttaccctgctcaatgccaatatcccatcccacagcatgctttgaaaggattaaagcctgttatcactcgcctgctacagcatggccttttaaagcctataaactctccttacaattcccccattttacctgtcctaaaaccagacaagccttacaagttagttcaggatctatgccttattaaccaaattgttttgcctatccaccccatggtgccaaacccatatactctcctatcctcaatacctctctccacaatccattattgtgttctggatctcaaacatgctttctttactattcctttacacccttcatcccagcctctctttgctttcacttggactgaccctgacacccatcaggctcagcaaattacctaggctgtcctgccacaaggcttcacagacagctcccattacttcagtcaagcccaaatttcttcctcatctgttacctgtctcagcataattctcataaaaacacacgtgctctccctgccaatcatctccgactaatctctcaaaccccaaccccttctacaaaacaacaactcctttccttcctgggcatggttggatacttttacctttagatacctggttttgccatcctaacaaacccattatataaactcacaaaaggaaacctagctgaccccatagatcctaaatcctttccccactcctctttccattccttgaagatggctttaaagactgcccccaccctagctctccctgactcatcccaacccttttcattacacacagccgaagtgcagggttgtgcagtcgaaatttttacaaaaggaacaggatcgcgtcctgtagcctttttgtccaaacaacttgaccttgctgttttagggtggccattgtgtctccgtgcagcagctgctgccaccctaatacttttagaggcccttaaaatcaaaaactatgctcaactcactctctacagctctcataatttccaaaatctagtttcttcctcacacctgatgcatatactttctgctccccagctccttcagctatactcactctttgttgagtcctccacaattaccattgttcctggccgggacttcaatcaggcctcccacattattccggataccacacctgaccctcatgactgcatctctctgatccacctgatgttcaccccatttccctatatgtctttctttcctgttcctcaccctgatgacgcttgatttattgatggcggttccaccaggcctaatcaccacacaccagcaaaggcaggctatgctatagtacaagccactagcctgcctcttaaaacctctcatttcctttccttcgtggaaatctatcctcaaggaaataacttctcagtgttccatctgctattctactactgctcaaggattattcaggccccctcccttccctacacatcaagctcggggatttgcccctgcccaggactggcaaattggctttactcaacatgccctgagtcaggaaactaaaatacctcttagtctaggtagacactttcactggatagatagaggcctttcctacagggtctgagaaggccaccactgtcatttcttcctttctgtcagacataattcctcagtttggacttcccacctctatacagtctgatagcagactggcctttattagtcaaatcagccaagcattttttcaggctcttagtattcagtgaaacctttatatcccttacagtcctcagtcttcaggaaaggtagaacagactaatggtcttttaaaaacacacctcaccaagctcagccaccaacttaaaaaagactagacaatacttttaccactttcccttctcagaatgcaggactgtcctcagaatgctgcaaggtacagcccatttgagctcctgtatagacgctcctttttattaagccccagtctcattccagacaccagaccaacttggactgtgccccaaaaaacttgtcatccctactattttctgtctagtcatactcctattcaccgttctcaactactcatacatgccctgctcttgtttacactgccggtttacactgtttctccaagccataacagctgatattggtgctatccccaaacggccactcttaactcttaaagaaaataaataatcttttctggcaggactatgctgaatttccttaggcactctctaattagatgtcctgggtcctcccaattcttagtcttttaatacctgtatttctccttctcttattccatttagtttttcaatccatacaaaaccgtatccaggtcatcaccaataattctacacgacaaatgtttcttctaacaaccccacaatatcaccccttaccacaaaatcttccttcagcttaatctctcccactctaggttcccatgccacccctaatcccactcgaagcagccctgagaaacatcgcccattatctctccataccatcccccaaattttcaccgtcccaacactttaccactatttcattttatttttcttattaatataagaagacaggaatgtcaggcctctgagcccaagctaagccataatatcccctgtgacctgcacgtacacatgcagatatctggttcctgccttaactggtgacattccaccacaaaagaagtgaaaatggcctgttcctaccttaactgatgacattgtcttgtgaaattccttctcctggctcatcctggctcaaaagctcccctactgagcacgttgtgacccccccactcctgcctgccagagaacaaccccccttttgcctttacttacccaaatcctataaaacagccccacccctatctccctttgctgactctcttttcggactcagcccgcctgcacccaggtaaaataaacagccatgttgctcacacaaagcctgtttggtggtctcttcacatggatgctaatgaaa

SEQ ID NO: 201 - DNA, 772 bp, Homo sapiens
gagagacaggactagctggatttcctaggccaactaagaatccctaagcctagctgggaaggtgaccgcttccacctttaaacacgtggcttgcaacttagctcacacccaaccagtcaggtaggaaaaagagctcactaaaatgctaattaggctaaacaggaagtaaagaaatagccaatcatctatcgcctgagaacacagtgggcgggacaataatcgggggatataaacccaggcattccagccagcaactgctaccctctttgggtcccctccatttgtatgcgagctctgttttcactctatttcactctattaaatctcccaactgcactcttctggtctgtgtttgttacggctggagctgagctttcgctcgccgtccaccattgctgtttgccgccgccacagacctgccgctgacttccatccctccggatccggcagggtgtctgctgtgctcctgatccagtgaggcgccccttgccgctcccgattgggctaacggcttgagattgctcctgcacggctaagtgcccaggttcgtccttatcgagctgaacactagtcactgggttccatggttctcttccgtgacccacggcttctaatagagctgtaacactcactgcatggctcaagattccattccttggaatccgtgaggccaagaaccccaggtcagagaacatgaggcttgccaccatcttggaagtggcccactgccatcttgggagctctgggagcaaggaccccccggtaacagttt

SEQ ID NO: 202 - DNA, 777 bp, Homo sapiens
gagagacaggactagctggatttcctgggccgactaagaatccctaagcctagctgggaaggtgaccacatccacctttaaacacgaggcttgcaacttagctcacacctgaccaatcagagagctcactaaaatgctaattaggcaaaaacaggaggtaaagaaatagccaatcatctattgcctgagagcacagcaggaggggcaaggatggggatataaacccaggcatttgagccagcaacagcaacccctttgggtcccctccctttgtatgggagctctgttttcactctacttcattctattaaatcttgcaactgcactcttctggtctgtgtttgttatggctggagctgagctttcgctcgccatccaccactgttgtttgccgctgtcacagacccgccactgacttccatccctccggatccagcagggtgtccgctgtgctcctgatccagcgaggcgcccattgccactcccgatggggctaaaggcttgccattgttcctgcatggctgagtgcctgggtttgtcctaatcgagccgaacagtagtcactgggttccacagttctcttctgtgacccacggcttctaatagagctgtaacactcaccacatggcccaagattccattccttggcatccgtgaggccaagaacctcatgtcagagaacacgaggcttgccaccatctttgaagcggcccgctgccattttggaagcgcccatcaccatcttaggagctctggaagcaaggaccccccggtaac

SEQ ID NO: 203 - DNA, 2802 bp, Homo sapiens
tgtggtcagaattcttacacaagagccaggaccaagccctgtagcctttctgtccaaacaacttgaccttactgttttagcctagccctcgtgtctgcgtgcagtggctgccgctgccttaatacttttagaggcccttaaaatcacaaattatgctcaactcactctctacagttctcataacttccaaaatctattttcttcctcacacctgatgcatatactttctgctccccgcctccttcagctgtactcactctttgttgagtctcccacaattaccattgttcctggcccgacttcaatccggcctcccacattattctggataccacacctgacccccatgactgtatcgctctgatccacctgacattcaccccatttccccatatttccttcttccctattcctcaccctgatcacatttggtttattgatagtagtttcaccaggcctaatcaccacacaccagcaaaggcaggctatgctataatgcaagccaccagcccgctttttagaacctctcatttcctttccattgtgggaatctatcctcaaagaaataacttctcagcgttccatctgctattctactactcctcagggattattcaggccccctcccttccctacacatcaagctcgaggatttgcccacccacccccgacccaggactggcaactcttaactccctcttaaagtggatagatgatctttgctggcaggggaccctccaatactttcaccctgatgaagttctattctttacttttatactcactcttattctcattcccattcttatgccaccctctacctctccccagctatctccactacactatcgaccttactattctctcctagccatttctaatccttccttagctaacaaccgctggctttgcatttccctttcttccagcgcctacacagctgtccccacttacatgcagattaggcaacatctcctgtctccctacacctctgaacttcctttaacagccctcacctttaccctcctgaagaactcatttactttctagacaggtccagcaagacctccccagacatttcacatcagcaagctgccgccctcctccgcacttacttaaaaaaacctttctccttatatcaactctactccccccatatttagacctctcacaacacaaactactattcctgtggccactggaattcccctgggtaacctttcaccttctcgatgttcctttactcttcatctccaaagccctcttcttgtttacttatacccagccctgtaaataacagtgaaaggttgctcgtagatactcaacgttttctcatacaccatgaaaatcgaacctcctcctctgtgcagttacctcatcagtccccattacaacctctgatggctgtggccctagctggatccctaggagtctgggtacaagacacccctttcagcactccttctcatctttttactttgcatctccagttttgcctcgcacaaggtgtcttcttcctctgtgtatcctctacctacatgtgtctacctgctaattggacaggcacatgcacactagttttccttactcccaaaattcaatttgcaaataggaccgaagagctccctgttcccctcatgacaccgacacgacaaaaaagagttattccactaattcccttgcttgtcagtttaagactttctgccttcactattgctctcggtactggaatagcaggcatttcaacctctgtcacgaccttccgtagcctctctaatgacttctctgctagcatcacagacgtatcacaaactttatcagtcctccaggcccaagttgactctttagctgcagttgtcctccaaaaccgccgaggccttgacttactgctgaaaaaggaggactctgtatattcttaaatgaagagtgttcattttacctaaatcaatctggcctggtgtatgacaacataaaaaactcaaggatagagcccaaaagcttgccaaccaagcaagtaattacgctgaacccccttggacaccctctaattagatgtcctaggtcctcccaattcttagtcctttaatacctgtttttctccttctcttattccgtttagtttttcaattcatacaaaaccgtatccaggccatcacgaataattctacacaacaaatgtttcttctaacaaccccacagtatcaccccttaccacaaaatcttccttcagcttaatctctcccactctaggttcccacgccgcccataatccctctcaaagcagccctgagaaacatagcccattatctctccataccaccccccaaaatttttgctgccccaacacttcaacactattttgttttatttttcttattaatataagaagacaggaatgtcaggcctctgagcccaagctaagccatcatatatcccctgtgacctgcacgtacacatccagatggcccgttccttccttaactgacgacattccaccacaaaagacatgaaaatggcctgttcctgccttaactgatgacattaccttgtgaaattccttctcctggctcatcctggttcaaaagctccctcactaagatcttgtgacccccccccacccctgcccgccagagaaccccctttttccctttacctacccaaatcttataaaatggccccacccctatctcccttcgctgactctcttttcggactcagcccgcctgcacccaggtgaaataaacagccttgttgctcacacaaagcctgtttggtgatctcttcacacggacgcgcgtgaaa

SEQ ID NO: 204 - DNA, 360 bp, Homo sapiens
gttaggcctctgagcccaagcctgcacatatacatccagatggcctgaagtaactgaagaatcacaaaagaagtgaaaatggctggttcctgccttaactgatgacattaccttgtgaaattccttctcctggctcagaagctctcccactgagcaccttgtgaccactgcccctgcccaccagagaccatccccctttgactggaattttcctttacctacccaaatcctataaaatggccccaccccatctcccttcactgactctctttttggactcagcccacctgcacccaggtgattagaaagcttaattgctcacacaaagcctgtttggtggtctcttcatatggacgcatg

SEQ ID NO: 205 - DNA, 2155 bp, Homo sapiens
tgcggtcagaattcttacacaagagccaggaccgcaccctgtagcctttctgtccaaacgacttaaccttactgttttagcctagccctcatgtctccatgcagcggctgctgccgccctaatacttttagaggccctaaaaatcacgaactatgctcaactcactctctacatttcttataacttccaaaatctattttcttcctcatacctgacgcgtatactttctgctccccggctccttcagctgtactcactctttgttaagtcccacaattaccattgttcctggcgtggacttcattctggctcccacattactcctgataccacacctgacccccatgcctgtatctctctgatccacctgacattcaccccatttccccatatttccttctttcctgttcctcaccctgatcacgcttgatttattgatggcggttccaccaggcctaatcgccacacaccagcaaaggcaggctatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcgaggatttgcccccacccaggactggcaaattagctttactcaacatgccccaagtcagagaactaaaatacctcttagtctaggtagacactttcactggataggtagaggcctttcctacagggtctgagaaggccaccgcagtcatttcttcccttctgtcagacctaattcctcagtttagctttcccatctctatacagtctgataacagactagcctttattagtcaaatcagccaagcagtttttcaggctcttggtattcagtgaaacctttatatcccttacagtcctccgtcttcaggaaaggtagaatggactaatggtcttttaaaaacacacctcaccaagctcagtcaccaactttaaaaggactggacaatacttttacctttttcttttctcagaattcaggcctgccctcggaatgttacagggtacggtccatttgagctcctgtatggatgctcctttttattaagccccagtctcatttcagacaccagaccaacttagactgtgccccccaaaaaacttgtcatccctactatcttctgtctagtcatactcctattcaccattctcaactactcatacatgccctgctcttgtttacactgctggcttacactgtttttccaagctgtcacagctgatatctcctggtgctatccccaaactgccactcttaactcttgaagtaaataaataatctttgctagcaggactatgctgaatctccttaggcactctctaattagatgtcctgggtcctcccaattcttagacctttaatacctgtttttctcctcctcttattccgtttagtttttcaattcatacaaaaccgtatccaggccatcaccaataattctaaatgacaaatgtttcttctaacagtcccacaatatcaccccttaccacaaaatcttccttcagcttaatctctcccactctaggttcccgtgccgcccctaatcccgctcgaagcagccctgagaaacatcgccaattatctctccataccatcccccaaaattttcgccatcccaacgctttaccactatttccttttatttttcatattaatataagaagacaggaatgtcaggcctctaagcccaagctaagccatcatatcccctgtgacctgcacttacacatccagatggccggttcctgccttaactgatgacattccaccacaaaagaaatgaaaatggcctgttcctgccttaactgatggcattatcttgtgaaattccttctcctggctcatcctggctcaaaagctcccctactgagcaccttgtgacgaccactcctgcctgccagagaacaacccccctttttcctttacctacccaaatcctataaaacggccccgcccctatctccctttgctgactctcttttcggactcagcccgcctgcacccaggtgattaaaagctttattgctcacacaaagcctgtttggtggtctcttcacacagatgcgcatgaaa

SEQ ID NO: 206 - DNA, 2197 bp, Homo sapiens
tgcggtcagaattcttacacaagagccaggacaacaccctgtagcctttctgtccaaacaacttgaccttactgttttagcctagccctcatgtctgcgtgcagcagctgccgctgctttaatacttttagaggccctcaaaatcacaaactatgctcaactcactctacagttctcataacttccaaaatctattttcttcctcatacctgatgcatgtactttctgcttcccggctccttcagctatactcactctttgttgagtctcccacaattaccgttgttcctggcctggacttcaatcctgcctcccacattattccagataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcaggttatgctatagtacaagccactagcctgcctcttagcacctctcatttcctttccatcgtggaaatctatcctcagggaaataacttctcagtgttccatctgctattctactactcctcagggattattcaggccccctcccttccctacacatcaagctccaggatttgcccccacccaggcctggcaaattagctttactcaacatgcccgagtcaggaaactaaaatacctgttagtctaaatagacactttcactgaataagtaaaggcctttcctacagggtctgagaaggccaccacagtcatttcttcacttctgtcagacataattcctcagtttacccctcccacctcaatacagtctgataacagacgagcctttattagtcaaatcagccaagcagtttttcaggctcttagtattcagtgaaatctttatatcccttatggtcctccgtcttcaagaaaagtagaatggactaaaggtcttttaaaaacacacctcaccaagctcagccaccaacttaaaaaggaccaatacttttaccactttcccttcccagaattcaggcctgtcctcggaatgctacagggtacagtccatttaagctcctgtatagacgctcctttttattaggccccagtctcattccagacaccagaccaacttggactgtacccccccgccaaaaaaaaacttgtcatccctactattttctgtctagtcatactcctattcaccgttctcaactactcatacatgccttgctcttgtttacactgccggtttacactgtttttccaagccatcacagctgatatctcctggtgctatccccaaactgccactcttaactcttgaagtaaataaataatctttgctggcaggactatgccgaatctccttaagcactctctaatcagatatcctgagtcgtaccaattcttagaccttttatacctgtttttctccttctgttattccatttagtttttcaattcatacaaaaccgtaccaggccatcacgaatcattctatatgacaaatgtttcttctaacatccccacaatatcacgccttaccacaagacctcccttcagcttaatctctcccactctaggttcccacactgcccctaatcccgcttgaagcagccctgagaaacatcgcccattctctctccataccacccccaaaaattttcgccaccccaacacttcaacactattttgttttatttttcttattaatataagaaggcaggaatgtcaggcctctgagcccaagccaagccatctcatcccctgtgacttgcccagatggcctgaagtaactgaagaatcacaaaagaagtgaatatgccctgccccaccttaactgatgacattccaccacaaaagaagtgtaaatggccggtccttgccttaactgatgacattacctcgtgaaagtccttttcctggctcatcctggctcagaaagcacccccactgagcaccttgtgacccccactcctgcccgccagagaacaaaccccctttgactgtaattttcctttacctacccaaatcctataaaacggccccacccttatctcccttcgctgactctttttggactcagcccacctgcacccaggtgaaataaacagccatgttgctcacacaaagcctgtttggggggtctcttcacacagacgcgcatgaaa

SEQ ID NO: 207 - DNA, 6181 bp, Homo sapiens
gtcaggcctctgagcccaagctaagccatcatatcccctgtgacctgcacgtatacatccagatggcctgaagtaactgaagaatcagaaaagaagtaatatttaaatggcctgttcctgccttaactgatgacattccaccacaaaagaagtgaaaatggctggtccttgccttaactgatgacattaccttgtgaaattccttctcctggctcatcctggcctaaaaagctccctgactgagcactttgtgacccccactcctgcctgccagagaacaacccctctttttcctttacctacccaaatcttataaaacagccccacccctatctccctttgctgactctctttttggactcagcctgcctgcacccaggtgaaataaacagccttgttgctcacacaaagcctgtttggtggtctcttcacatggatgcgagttaaattttggtgctgtgactcagatcaggggacctcccttggcagatcaatcccctgtcctcctgctctttgctccgtgagaaagatccacctacaacctcagatcctcagactgacctgcccaaggaacaccacacccattttaaatcaggtaagcggcctctttttactctcttctccaacctctctcactatccctcaacctctttctcctttcaatcttggcgccacacttcagtctctcccttctcttaatttcagttcctttccttttctcatagagacaggagacgcattttatccggacccaaaactccggcgccagtcacggactcaggaagacagtcttcccttggtgtttaatcacatggggatgcctgcctgattattcatccacgtttcagaggtgtctgaccacgcgaggaagcctgccttggtccttcacccttagtggcaagtaccacttttctggggggcaagaaccccccgaccccttctctccatgtctctatcccttctctgcttttctagggggcaagaaccccctgactccttctctccatgtctctaccccttctctgcttttctggaaggcaagaaccccccagccccttctccttcacccttagcagcaagtactgcttttctagggggcaacaacccccccaaccccttctctccgtgtctctactgcttctccacttttgtggggggcaagaaccccccaacccctcctctccgtgtctctaccccttttccactttcctgggggcaagcaccccccaccccttctctccgtgtctctactctctcttttctctgggcttgcctccttcactatgggcagccttccaccctccattcctccttcttctcccttagcctgtgttctcaagaacttaaaacctcttcaactcacacctgacctaaacctaaatgccttatttttcttctacaatgccgcttgaccccaatataaactcgatagttgttccaaatagccagaaaacagcactttcaatttttccatcctacaagatctagataattcttattgtaaaataggcaaatagtctgaggtgcctgacgtccaggcattcttttacacattgttccctccctagtctctgttcccaatgtgactcatcccaaatcctccttctttccctcccgcctgtcttcccagtcccaaccccaagcgtcgctgagtctttctaatcttccttttctacagacccatctgacttctccccttctccccaggctgctcctagccaggctgagccaagtcccaattcttcctcagcctctgatcccccacactataatccttttatcacctcccttcctcacaccgggtccagcttacagtttccttccacaactagccctcccccacctgcccagcaatttcctcttaaaaaggtggctggagctagaggcatagtcaaggttaatgctcctttttctttatcagacctctcccaaaatcagttagcatttaggctctttttcatcaaatatgaaaaacccagcccagttcatggcttgttcggcagcaaccctgagacgctttacagccctagaccctaaaaggtcaaaaggccatcttattctcaatatacattgtattacccaatctgctcctgacattaaataaaactccaaaaattaagttccagccctcaaaccccacaacaggacttaattaacctcaccttcaaggtgtacaataatagagtagaggtagccaagtagcaatgtatttctgagttgcaattccttgcctccactgtgagacaaaccccagccatatctccagcccacaactccaaatgcctgaactgcagctgccgggggttcctccagaacctcctcccccaggagcttgctacacatgccagaaatctggccactgggccaaggaatgcccacagcccgggattcctcgtaagccatgacccatctgtgtgggaccccactgaaaattggactgttcaactcacctggcagccatttccagagaccctggaactctggcccaaggctctctgactccttccccaatcttctcagcttagtggctgaagactgacactgcccgatcgcctcagaagccccctaaaccatcacggatgctgagcttcaggtaactctcacaatggaaggtaagtccgtcccattcttaatcaatacggacgctacccactccacattaccttcttttcaagggcctgtttcccttgcctccataactgttgtaggtattgatggccaggcttctaaacctcttaaaactccccaactctggtgctaacttagacaatactcttttaagcactcctttttagttaaccccacctgttcagttcccttattaggctgagacactttaactaaattatctgcttccctgactattcctgggctacagccacacctcattgccatcttttcccccagttcaaagcctccttcacatcctccccttgtatctccccaccttaacccacaagtataagacacctctactccctccttagtgaccgatcatgcaccccttaccatcccattaaaacctaatcacccttaccctgctcaatgccaatatcccatcccacagcatgctttaaaaggattaaagtctgttatcactcacctgctacagcatggccttttaaagcctataacctccccttacaattcccccattttacctgtcctaaaaccagacaaggcttacaggttagttcaggatctgcgccttatcaaccaaattgttttgcctatccacactgtggtgccaaacctatatactctcctatcctcaatacccattattaataccctcaataccctccacaacccattattctgttccagatctcaaacttgctttctttactattcctttgcacccttcatcccagcctctcttccctttcacttggactgaccctgacacccatcaggctcagcaaattacctgggctgtactgctgcaaggcttcacagacagcccccattacttcagtcaagcccaaatttcttccttatctgttacctatgatggcataattctcataaaaacacacgtgctctccctgctggtcatgtctgactgatctctcaaaccccagcaccttctacaaaacaactcctttccttcccaggcatggttagatactttcaactttagatacctggttttcccattataacaaaaccattatataaactcacaaaaggaaacctagctgactccatagatcctaaatcctttccccactcctctttccattccttgaagacaactttagagactgcccccactctagctctccctgactcatcccaacccttttcattacccacagctgaagtgcagggctgtgcagtcagaattcttacacaaggaccaggatcgcatcctgtagcctttttatccaaacaacttgaccttactgttttgtctagccctcaagtctgcgtgcagcagctaccaccaccctaatacttttagaggcccttaaaatcacaaactatgctcaactcactctctacagttctcttaacttccaaaacctattttcttcctcacacctgacacgtatactttctgctccctggctccttcagctgtactcactctttgttgagtctcccacaattaccattgttcctggcctggacttcaatccggcctcccacattattcctgataccacacctgaccgccatgactgtatctctctgatccacctgacattcaccccatttccccatatttccttctttcctgttcctcaccctgatcacagttggtttattgatggcagttccaccaggcctaattgccacacaccagcaaaggcaggctatgctatagcacaagccactagccaacctctaagaacctctcatttcttttccatcgtggaaatctatcctcaaagaaataacttctcagtgttccatctgctattctactactcctcagggattgctcaggcctcccttcctttccctacacatcaagctcagggatttgcccctgcccaggactggcaaattagctttactcaacatgccccaagtcaggaaactaaaatacctcttggtcagggtagacactttcactggataggtagaggcctttcccacagggtctaagaaggccaccacagtcatttcttcccttctgtcagacataattcctcagtttggccttcccacctctatacagtcctataacagaccagcctttattagtcaaatcacccaagcagtttttcaggctcttagtattcagtgaaacctttatgtcctttacagtcctcaatcttcaggaaaggtagaacggactaatggtcttttaaaaacacacctcaccaagctcagccaccaacttaaaaaggactggactggccgggcaccgtggctcatgcctgtaatcccagtactttgggaggctgaggcaggcagatcacgaggtcaggagatcgagaccattctggctaacacggtgaaaacctgtctctactaaaaatacaaaaaattagccaggtgtggtggcaggtgcctgtagtcccagctactccggaggctgaggcaggagaatggcatgaacccaggaggcggagcttgcagtgagccaagatcgtgccactgcactccagacagagtgcagtgcaagactccatctcaacaaaaaaaaaaaaggactggacaatacttttaccactttcccttcgcagaattcaggcctgtcctcagaatgctataggttacagcccatttgagctcctgtatagacactcctttttattaggtcccagtctcattccagacaccagcccaacttgaactgcaccccaaaaacttggatagagcctaaaaattcaccaaccaagcaagtaattacgctgaacccccttgggcactctctaattagatgtcctgggtcctcccaattcttagtctaatatctgtttttctccttctcttattccatttagtttttcaattcacacaaaacagtatccaggccatcaccaataattctatacaacaaatgtttcttctaacaaccccataatatcgccccttaccataaaatcttccttcagcttaatctctcccactctaggttcccacgccgcccctaatcccgctcgaagcagccctgagaaacatcgcccattatcaatccatgccaccccccaaaaaaattttctccccaccccaacacttcaacactattatgttttatttttcttattaatacaagaagagaggaatgtcaggcctctgagcccaagctaagccatcacatcccctgtgacctgcacatctacatccagatggcctgaagtaactgaagaatcacaaaagaagtgatatttaaatggcctgttcctgccttaactgatgacattccaccacaaaagaagtgaaaatggctggtccttgccttaactgatgacattaccttgtgaaattccttctcctggctcatcctggcctaaaaagctccctgactgagcaccttgtgaccccccactcctgcctgccagagaacaacccccttttttcctttacctacccaaatcttataaaatggccccacccctatctcccttcgctgactctctttttggactcagcccgcctgcacccaggtgattaaaagctttattgctcacacaaagcctgtttggtggtctcttcacacaga

SEQ ID NO: 208 - DNA, 327 bp, Homo sapiens
ctcctgatcgggctagaggctcgccattgttcctgcatggctaagtgcctgggttcgtcctaattgagctgaacgctagtcgctgggttccacggttcacttctgtgacccacggcttctaatagagctataacactcaccacatggcccaagattccattccttggaatccgggaagccaagaaccccaggtcagagaacaggaggcttgccaccatcttggaagtggcccaccaccattttgggagctctaaaaacaaggacctcccccggtaacatgtgcacatgaacacacacacacagaggtggcctctcacagtggaccac

SEQ ID NO: 209 - DNA, 989 bp, Homo sapiens
gtggggaaaagaaagaaagatcagtttgttactgtgtctatgtagaaaaggaagacgtaagaaactccattttgatctgtactaagaaaaattgttctgctttgagatgctgttaatctgtaactttagccccaaccctgtgctcacagaaacatgtgctgtattgattcaaggtttaatggatttaggtctgtgcagaatgtgccttgttaacaatatgtttgcaggcagtatgcctggtaaaagtcatcgccattctccattctcgattaaccacggacacaatgcactgcagaaagccgcagggacctctgcccaagaaagcctgggtattgtccaaggtttccccccactgagacagcctgagatatggcctcgtgggaaaggaaaaaccttacatcctccagcccaacacctgtgaagggtctgtgctgaggaggagtagtgaaagagggaggcctctttgcagttgagataagaggaaggtttctatctcctgctcgtccctgggaatggaatgtcggggtgtaaagccaaccattcgttctattctgagataggagaaaaccgccccgtggctggaggtgagatatgctggcagcaatactgctctgttactctttgctacagtgagatgtttgtgtaaagtgaaacataaatctagcctctgtgcacatccagacatagtacctttccttgaacgtattcatgatacagattcctttgctcacatttttccctgctgaccttctccccaccatcaccctgttgccctgccacactcccctcgccaagatagtaaaaatagtgatcaataaatactaagggaaatcagagaccagcgctggtgtgggtcctcacacgttgagcgccggtctcctgggcccactgttctttctctgtactttgtgtctgtgtcttatttcttttctcagtctctcgtctccacctgacgagaaatacccacaggtatggaggggcaggccccc

SEQ ID NO: 210 - DNA, 698 bp, Homo sapiens
gacatgacaaagttggcacatgtgcctgtactggtttaacacaggtttgatcctaggtctttatttaaaagatagtttccagctataagagaatttaaaaccctcactgcaagtgtattacataaaacactatcactctgtctcccaaagagactcaaagtaaaaataaaagcgagaactcccactaatttgtgaaaattctcaaaggaagggataaggagaccactactactcctgctgccctcctccctgccaccttgcctagttcataagacaggaggaaaagagagaaagcaaaaagttagaaagaaacaaaagtcagataaatagccagacaaccttggcaccaccacgtggccctaggagttaaaaaaaataataataataacatcaacccccgacctaaactacttgtgttatctgtaaattccagacattgtatgaaaaaagcattgcaaaactttctgttctgttagctgattcatgtagcccccagtcacgtttcccatgcttgctcaatttatcacgaccctttcacgtggacccttaaagtcgtaagcctttaaacaggccaagaatttcttttttggggagctcagctcttaagacgcaagtctgccgatgctcccggccgaataaacctctttcttctttaatccggtgtctgaggagttttgtctgtggcttgtcctgctaca

SEQ ID NO: 211 - DNA, 389 bp, Homo sapiens
gtcaggcctctgagcccaagctaagccatcatatccccagtgacctgcatgtatacatccagatggcctgaagcaagtgaagaatcacaaaagaagtgaaaatggccggttcctgccttaactaatgacattaccttgtgaaattccttctcctggctcagaagctcccccactgagcaccttatgacccccccacccctgcccaccagagaacaacaaccccctttgactgtaattttccactacctacccaaatcctataaaacggccccacccctgtctcctttcccagactctcttttcggactcagccagcctgcacccaggtgattagaaagctgtattgctcacacaaagcctgtttgttggtctcttcacacggatgcatg

SEQ ID NO: 212 - DNA, 225 bp, Homo sapiens
tttgcaaaggctccttatgacttgccatatgcttttcgttcctgttaccccactccccaggccaagttttccagtgacttttgaagtagtttgtacaactgcatagggcctcactctggccctttaaggatcccacttacttactttttttgagttagcacccctttgggaggaggggaaattcttcctttgccatttgtgagtttttactccaatccccatgtc

SEQ ID NO: 213 - DNA, 4724 bp, Homo sapiens
gtcaggcctccgagccaaagctaagccatcatatcccctgtgaactgcatgtacacatccagatggcgggttcctgccttaactgatgacattccaccacaaaagaagtggaaatggcctgttcctgccttaactgatgacattaccttgtgaaattccttctcctggctcatcctggctcaaaagctccctcactgagcaccttgtgactcccacccctgcccaccagaaaagaaccccctttgactgtaattttcctttacctacgcaaatcctataaaacggccccaccccatgtcccttcgctgactcttttcggactcagcctacctgcacccaggtgattcaaaagctttattgctcacacaaagcctgtttggtggtctcttcacacggacgcgagtgaaatttggtgccgtgactcagatcgggggacctcccttgggagatcaatcccctgtcctcctgctctttgctccgtgagaaagatccacctacgacctcgggtcctcagaccaaccagcccaaggaacatctcaccaattttaaatccagtaagcggcctctctttactctcttctccaacctccctcactatccctcaacctcgttctcctttcagtcttggtgccacacttcaatctctcccttctcttaatttcagttcctttccttttctggtagagacaaaggagatgcgttttatctgtggacccaaaactctggcaccggtcacggacttgggaagaccgtcttcccttggtgtttaatcattgcggggactcctgcctgattatacacccacaatccattggtatctgatctccgtggggacgcctgccttggtcattcacccacattcccttggtggcaagtcaattgcggggatgcctgctttggctgctcacccacattgcagccagggctgctcacccaacccattctctctgtgtctctaccctctcttctctccactttcctggggggacaagcatcccccaccccttctccactttcctggggggcaagcatcccccaccccttctctccgtatctctacccttctttttaaacttgtctccttcactatgggcaaccttccaccctctattcctccttcttctcccttagcctgtgttctcaagaacttaaaacctctttaactctcgcctgacctaaaatctaagtgtcttattttcttctgcaacaccgcttgaccccaatacaaactcgacagtggttccaaatagccagaacacggcactttcgatttttccatcctacaaaatctagataattcttgtcgtaaaatgggcaaccggtctgaggtgcctgacatccaggcattcttttacacatcggtccctccctagtctctgttcccaatgcaacttgtcccaaatcttccttctttccttcccgcctgtcccctcagtcccaaccccaagcgtcactgagtcttttgaatcttccttttctacagacccatctgacctctcccctcctccccaggctgctctgcgccaggctgagctaggtccgaattcttcctcagcctccatttccccaccctataatccttttatcaccttccctcctcacacccggtctggcttacagtttaattctgcgactagccctcccccacctgcccagcaatttcctcttaaaaaggtggctggagctaaaggcatagtcaaggttaatgctcccttttctttatccgacctctcccaaatcagttagtgtttaggctctttttcatcaaatatgaaaaagccagcccagttcatggctgtttggcagcaactgtgagatgctttacagccctagaccctaaaaggtcaaaaggccatcttattctcaatatacattttattacccaatccgctcccgacattaaataaaccccccaaattaaattccggccctcaaaccccacaacaggacttaattaaccttgccttcaaggtgtacaataatagagtagaggcagccaagtagcagtgtatttccgagttgcaattccttgcctccactgtgagataaaccccaaccacatctccaggacacaagaacttcaaacgcctgaaccgcagctgccaggcattcctccagaacctcttcccccaggagcttgctacgagtgttggaaatctggccactgggccgaggaatgcccccagcccgggattcctcctaagccatgtcccatctgtgcgggaccccactgaaaattggactgttcaactcacctggcagccactcccagagcccctggaactctggcccaaggctgtctcactgactccttcccagatcttcttggcttagtggctgaagactcacgctgcccgatcgcctcagaagccccctagaccatcacggatgctgagcttcgggtaactctcacagtggagggtaagtccgtccccttcttaatcaatacggaggctacccactccacattaccttcaagggcctgtttcctttgcctccataactgttgtaggtattgacagccaggcttctaaacctcttaaaactccccaactctgccaacttggacaacattcttttatgcactcttttttagttatccccacatgcccagttcccttattaggccgagacattttaaccaaattatctgcatttcaactaaattatctgcttccctgactattcctggactacagccacatctcattgccgcccttcttcccaacccaaagcctcctttgtgtctccctcttgtatctccccaccttaatccacaagtatatcatgcaccccttaccatcctattaaaacttaatcacccttaccctgctcaatgccaatatcccatcccacagcacgctttaaaaggattaaagcctgttatcactcgcctgctacagcatgggcttctaaagcctacaaactccccttacaattcccccattttacctgtccgaaaaccaggcaagcctcacaggctagttcaggatctgcgccttatcatccaaattgttttgtctatccaccccgtgatgccaaacccatatactctcctatcctcaatacctccctccacaacccattattctgttctggatctcaaacatgctttctttactattcctttgcacccttcatcccagcctctctttgctttcacttggactgaccctgacacccatcaggctcagcaaattacgtgcgctgtactgccacaaggcttcacagacagcccccattacttcagtcaagcccaaatttcttcctcatctgttacctatctcggcataattctcatgaaaacacacgtgctctctccctgctgatcgtgtgcagctaatctcccaaaccccaatcccttctataaaacaacaactcctttccttcctaggcatggtcagtgcagtcagaattcttatgcaagagtcgggactgcgccccgtagcctttctgtccaaacaacttgaccttactgttttagcttatccctcatgtctgcgtgcagcagctgccgctgctttaatacttttagaggccctcagaataacaaactatgctcaactccctctctaatcttttctggcagggctatgctgaacctccttgggcactcaattctgtcctgggtcctcccaattcttagtcatttaatacctgttttttttcttctcttattcggaccttgtgtcttccgtttagtttttctttttcttttctttttctttttttttttttttttttttgagacagagtctcactgtgtttcccaggctggagtgcagtggcgcgatctcggctcactgcaagctctgcctcccgggttcacgccattcttctgcctcagcctcccgagtagctgggactacaggcacccgccaccatgctccgctaattttttgtatttttagtagagacggggttacaccgtgttagccaggatggtctcaatctcctgacctcatgatccacccgcttcagcctcccaaaatgctgggattacgggtgtgagccaccgcgcccgacctgcgtttagtttttcaattcatacaaaaccgcatccaggccatcaccaatcattctatacgacaaatgctccttctaacaaccccacaatatcacctcttaccacaaaatcttccttcagcttaatctctcccactctaggttcccacgccgcccctaatctcgcttgaagcagccctgagaaacatcgcccattatctctccataccacccccaaaaaattttcgctgccccaacacttcaacattattttgttttatttttctaattaatataagaagacaggaatgtcaggcctctgagccaaagctaagccatcatatcccctgtgacctgcatgtacacatccaggtggccggttcctgccttaactgatgacattccaccacaaaagaagtgaaaatggcctgttcctgccttaactgatgacattaccttgtgaaattccttctcctggctcatcctggctcaaaagctcccccactgagcaccttgtgacccccactcctgcccaccagagaacaaccccctttgactgtaattttcctttacctacgcaaatcctataagacggcccaccccatctcccttcgctgactctctttttggactcagcctgcctgcacccaggtgattcaaaagctttattgctcacacaaagcctgtttggtggtctcttcacacggacacgagtgaaa

SEQ ID NO: 214 - DNA, 748 bp, Homo sapiens
gagagacaagactagctggatttcctaggccaactaagaatccctaagcctagctgggaaagtgatcacttccacctttaaacatggggcttgcaacttagctcacacccgaccaatcagatagtaaagagagctcactaaaatgctaattaggcaaaaacaggggtaaagaaatagccaatcatctattgcctgagagcacagctggagggacaactatcaggatataaacccaggcattcgagctggcaatggctaccctctttgggtcccctccctttgtacgggggctctgttttcactctattaaatcttgcaaccgcactctcttctggtccatgtttgttacagctcgagctgagctttcgcttgccgtccaccactgctgtttgccgccgtcgcagacctgccactgacttccatccctctggatctggcagggtgtctgctgtgctcctgatccagcaaggcgcccattgccactcccgatcggactaaaggcttgccattgttcctgcatggctaagtgcccaggttcgtcctaatcgagctgaacgctagtcactgggttccacagttctcttccgtgacccacagcttctaatagagctataacactcaccacatgtcccaagattccattccttggaatccatgaggccaagaaccccaggtcagagaacccaaggcttgctaccatcttggaaatggcctgccaccatcttgggagctctgggagcaaggaccc

SEQ ID NO: 215 - DNA, 5827 bp, Homo sapiens
gtcaggcctctggtcccaagcctgcacatatacatccagatggcctgaagtaactgaagaatgacaaaagaagtgaaaatggtcggttcctgccttaactgatgacattaccttgtgaaataccttctcctggctcatcctggctcaaaagctcccccactgagcaccttgtgacccccacacctgccagccagagaataactcccttttactatacttttccactacctacccaaatcctataaaacggtctcacccctatctccctttgctgactctcttttcagactcagcccgcctgcacccaggtgattaaaaaggtttattgctcacacaaagcctgtttggtgatctcttcacacggatgcaggtgaaatttggtgtcatgactcggatcaggggacctcccttgggagatcaataccctgtcctcctgctctttgctccatgagaaaggtgcacctacaacatcgggtcctcagaccaaccagcccaaggaacatctcaccaattttaaatcatgtaagcggcctctttttactctcttctccaacctctctcactatccctcaacccctttctcctttcaatcttggtgccatccttcaatctctcccttctcttaatttcaattcttttccttttctggtagagacagaggagatgtgttttatccacgaccccaaaactccggtgctggtcatgaactcaggaaaacagtcttcccttggtgtttaatcactgcaaggatggctgcttgattattcacccacgtttcagaggtgtctgatcaccgcggggatgcctgccttgatccttcacccttagcggcaagcactgcttttctgggggcaagcagcccccaccctttctctccgtgtctctaccccttttccacttccctgggaggcaagcacctcccacccttctccactttccttgggggcaagcaccccccaccccttctctccatgtcctctcttttctctgggcttgcctccttcactatgggcaaacttccaccctccattcctccctcttctcccttagcctgtgttctcaaaaacttaaaacctcttcaactcacacctgacctaaaacctaaatgccttattttcttctgcaacaccgcttggccccaatacaaacttgataatggctctaaatggccagaaaactgcattttcagtttctccatcctacaagacctagataatttttgtcaaaaaatgggcaaatggtctgaggtgccttacatccagacatttttcacacttcgttccctccctagtctctgttcccaatgcaattcctcccaaatcatccttgtttccctcccgcctgtcccctcagtcccaacctcaagcatcgctgagtctttccaatcttccttttctacagacccatctgacctctctcctcctccccaggctgctcctcaccaggccaagccaggtcccagttcttcctcagcctctgctcctccaccctataatctttctatcacctcccctccttacacctggtctggcttacggtttagttctgtgactagctctccccaacctgcccaacaatttcctcttagagaggtggctggagctgaaggcatagtcagggtacatgtgcctttttctctatcggacctctctcagatcagtcagcgtttaggatctttctcatcaggccctactaaatatatacatgaattccaatatctaactctgtcctacaatttaacctggagtgacttaaatgtcatcctaacttttatcctcccactagatgaatgggaaagagttttttctctggcccaatctcacactgacaactgtcggctccacaagccagacctccaggaaggcattagagaagttccccaagaggatccccaatggaactatcaggaaaattccccaggtatagctaggcgagattacatgatttcctgcctagttgaagggcttaaaaaggcagcttacaaagctattaattatgacaagcttaaagaaactacccaaggtacagacaaaaacccagcccagtccatggcttgtttggcagcaaccatgagacactttgcagccctagaccctgaaggtcagaaggctgtctcattctaaatatgcattttatcacccagtcagctcctgacattagaaaagaacttcaaaaattagaatccggccctcaaaccccacaataggaattaatcaacctcgccttcaagatgtacagtaatagagaggagacaggcagatggcaacgcatttctgagttacaattacttgcctctgctgtgagacaaaacccagccgcacctccagcacacaagaacttcaaaatgcctaagctgcacatgcctaagccacagcagtcaagcattcctacaggacttcctccatcaggatcttgcttcaagtgccagaaatctggccactgggccaaggaatgcctgcagcctgggattcctcccaagctgtgtcccatctgtgcagggacccactggaaatcagactgcccagctcacccagcagccactcctagagctgctaaagctctaggccaaggctctctgactgactccttcccagatctgctcagcttagcggctgaagactgacgctgcccaatcacctcagaaaccccctggaccaacacggactccgagtttcgggtaattctcacagtggactgaccctgacacccatcagtcccagaagcttacctgggctgtgctgcctcaaggcttcagggacagccctcattacttcagccaagctctttctcatcatttactttctttccacccctccacttctcaccttattcaatatattgatgaccttctactttgtagcccctccattgaatcttcccaacaagacaccctcctgctccttcaacatttattctccaaagggtatcgggtatcccccaccaaagctcaaatttcttctccatccgttacctacctcagcataattcttcataaaaacacacatgctctccctactgatcacgtccaactgatctctcaaaccccaaccctttctacaaaacaactcctttccttcctaggcatggttggatactttcacctttggatacctggttttgccatcctaacaaaaccattatataaactcacaaaaggaaacctagctgaccccatagatcctaaatcttttccccactcctctttccgttccttgaagacagctttagagactgctcccacactagctctccctgactcatcccaatccttttcattacacacagccgcagtgcagggctgtgcagctggaattcttacacaaggaccgggactgtaccctgtagcctttttatccaaacaacttgaccttactgttttaggctggccatcatgtctccgtgcagcggctgccaccgccctaatacttttagaagaccccaaaatcacaaactatgctcaactcactctctacagctctcataacttccaaaatctattttcttcctcacacctgacacatatactttctgctccccagctccttcagctatactcactctttgttgagtctcccacaattaccattgttcctggcccagacttcaatccagcctcccacattattccagataccacacctgacccccatgactgtatctctctgatccacctgactttcaccccatttccccatatttccttctttcctgttcctcaccctgatcacatttggtttattgatggcagctccaccaggcctaatcagcactcaccagcaaaggcaggctatgctatagtatcttccatgtctatcattgaggctaccactctgcctccctccactacctctcagcaagctgaactcattgccttaacttgggtcctcactcttgcaaagggactacacatcaatatttatactgactctaaatacaccttccatatcctgcactaccatgctgttatatgggcagaaagaggtttcctcactatacaagtgtcctccatcattaatgcctctttaataaaaactcttctcaaggctgctttacttccaaagaaaggtggagtcattcactgcaagggccaccaaaaggcatcagatcccattgctctaggcaatgcttatgttaataaggtagctaaagaagtagctagcattccaacttctgtccctcatggccagtttttctccttctcatcggtcactcccacctactcccccactgaaacttccacctatcaatctcttcccacacaaggcaaatatcttagaccaaggaaaatatctccttccagcctcacaggcccattctattctgtcatgatttcataacctcttccatgttggttacaagctgctagcccgtctcttagaacctctcattttctttccatcatggaaatctgtcctcaaggaaatcacttctcagtgttccatccgctagtctactgtccctcaggtattgttcaggccccctcccttccgtacacatcaagcttggggatttgcccctgctcaggactggcaaattgactttactcacatgtcctgagtcaggaaactaaaatacctcttggtctgggtagacactttcactggatgggtagaggcctttcccacagggtctgagaaggccaccgtggtcatttcatcccttctgtcagacataattcctcagtttggccttcccacctctgtacagtctggtaacggaccggcctttactagtcaaattacccaagcagtttctcaggctcttggtattcagtggaaccttcataccccttaccatcctcaatcttcaggaaaagtaaaacagactaatggtcttttaaaaacacatctcaccaagctcagcctccaacttaaaaaggactggacaatacttttaccacttgcccttctcagaattcgggcctgtcttcaggatgctataggttacagcccatttgagcttctgtatggacactcctttttattaggccaccagcccacttgaactgcaccccaaaaacttggatagagcctaaaaactcaccaaccaagcaagcaattacgctaagccccctcggcactctctaattggatgtcctgggtcctcccaattcttagtcctttaatacctgtttttctccttctcttatttggaccttgtgtcttccgtttagtttctcaattcatacaaaactgcattgaggccatcaccaatcattctatatgacaaatgctccttttaacaaccccacaatatcgcctcttaccacaaaatcttccttcagcttaatctctcccactctaggttcccatgctgcccctaatcccgctcgaagcagccctgagaaacatcacccattatctctccataccactgccaaaacttttcactgccccaacactttaccactatttcattttatttttcttattaatataagaagacaggaatgtcaggcctctgggcccaagcctgcacgtatacatccagatggcctgaagtaactgaagaatgacaaaagaagtgaaaatagccagttcctgccttaactgatgacattaccttgtgaaacatcttctcctggctcatcctggctcgaaagctcacccactgagcaccttgtgaccctgacccctgctagccagagaacaaccccctttgactgtaattttccactacctacccaaatcctataaaatggccccacccctatctccctttgctgactctcttttcggactcagcctgcctgcacccaggtgattaaaaagctttattgctcacgcaaagcctgtttggtggtctcttcacatggatgcgcatgaaa

SEQ ID NO: 216 - DNA, 2668 bp, Homo sapiens
tgcggtcagaattcttacacaaggaccaggaccgcaccctgtagcctttttatccaaacaacttgaccttactgttttagcctagccctcaagtctgcgtatggcggctaccactgccctaatacttttagaggcccttaaaatcacaaactatgctcaactcactctctacagttctcataacttccaaaatctattttcttcctcacacctgacacatatactgtctgcttcccggctccttcagctgtactcactctttgttgagtctcccacattattccggataccacacctgaccctcatgactgcctctctctgatccacctgacgttcaccccatttccccacatttctttctttcatgttcctcaccctgaacacacttagcttattgatggcagttccaccaagcctaatctccactcaccagcaaaggcaggctatgctatagtatcttccacatctatcattgaggctaccgctctttccccctccactacctctcagcaagccgaactcattgccttaagtcaagccctcactcctgcaaaaggactaaatgtcaatatttatactgactctaaatatgccttccatatcctgcacctccatgcaagaggtttcctcactacacaaatgtcctctatcattaatgcctctttaataaaaatgcttctcaaagctgctttacttccaaaggaagctagagtcattcactgcaaaggccatcaaagggcatcagatcccatcgctcaggacaatgcttatgctgataagatagctaaaaaagcagctagcattccaacttatatccctcactttcactttttctccttcccctcagtcactcccacctactcccctgctgaaacttccacctatcaatctcttcccacacaaggcaaatagttcttagaccaaggaaaatatctccttccagcctcacaggcccattctattctgtcgtcatttcataacctcttccatgtaggttacaagccgctagcccgtctcttagaacctctcatttcctttccatcctggaaatctatcctcaaggagatcacttctcagtgttccatctgctattctactacccctcagggattgttcaggccccctcccttccctacacatcaagctcaaggatttgtccctgcccaggactggcaagttgactttactcacatgccccgagtcagaaaacgaaagtatctcttagtctaggtagacactttcactggatatgtagaggcctttcctacaaggtctgagaaggccactgcggtcatttcttcctttctgtcagacataattccttggtttagccttcccacctctatacagtccgatagcagaccggcctttattagtcaaatcagccaagcattttttcaggctcttagtattcagtgaaacctttatctcccttacagtcctcagtcttcaggaaaggtaaacggactaaaggtcttttaaaaacacacctcaccaagctcagccaccaacttaaaaaagactagaccatacttttaccactttcccttctcagaattcaggcttgtcctcggaatgctacaaagtacagcccatttaagctcctgtttagacgctcctttttattaggccccagtctcattccagacaccagaccaacttagactgtgccccaaaaaacttgtcatccctactatgttctgtctagtcatactcctattcaccgttctcaactactcatacatgccctgctcttgtttacactggcagtttacactgtttctccaagccatcacagctgatatctcctggtgctatccccaaactgccactcttaactcttaaagtaaataaataatctttgctggcaggactatgctgaatctctttaggcactctctaattaaatgtcctaggtcctcccaattcttagacctttaatacctgtttttctccttctcttattctgtttagttttccaattcatacaaaactgtatccaggccatcaccaataattctaaatgacaaatgtttcttctaacagtcccacaatatcgccccttaccacaaaatcttccttcagcttaatctctcccactctaggtccccacaccacccctaatcccgctcgaagcagcccattatctctccataccatcccccaaaattttcgccatcccaacactttaccactatttcgttttatttttcttattaatataagaagacaggaatgtcaggcctctgagcccaagctaagccatcatatcccagatggccagttcctgccttaactgatgacattccaccacaaaagtgaaaatggcctgttcctgccttaactgatgacattccaccgcaaaagtgaaaacggcctgttcctgccttaactgatgacattatcttgagaaattccttctcctggctcatcctggctcaaaagctcccctactgagcaccttgtgacccccactcctgcccatcagagaacaacccccctttgactgtaattttcctttaactacccaaatcttataaaacggccccacccctatctccctttgctgactcttttcggactcagcccgcctgcactcaggtgattaaaagctttattgctcacacaaagcctgtttggtggtctcttcacacggacactcatgaaa

SEQ ID NO: 217 - DNA, 5945 bp, Homo sapiens
gtcaggcctctgagcccaagcctgcacatatacatccagatggcctgaagcaactgaagaatcacaaaagaagtgaaaatgctgaagcaactgaagaatcacaaaagaagtgaaaatggccggttcctgccttaactgataagacagtcacctgtcctcctgctctttgctctgtgagaaagatccacctacaacctcgggtcctcagaccaaccagctccaggaacatctcaccaattttaaattgggtaagcagcttctttttactctcttctccaacctctctcactatctctcaacctctttctcctttcaattttggcaccacccttcaatctatcccttcccttaatttcagttcctttccttttctgatagagacagaggagatgtgttttatccgtgaacccaaaactccggcactggtcacggactcgagaagacagtcttcccttggtgtttaatcactgcagggatgcctgcctgattattcacccacatttcagaggtgtctgatcaccacagggacacctgccttgatccttcaccttggtgtcaagtaccgaccccccctgtgtctctgccctctcttttctctgggcttgcctccttcactatgggcaaccttccaccctccattcctccttcttctcccttagcctgtgttctcaagaacttaaaacctcttcaactctcgcctgacctaaaacctaaacaccttattttcttctgcaataccacctgaccccaatacaaacttgacagtggttccaaatagccagaaaatggcactttcaatttctccaccctacaagatctagataattcttgtcgtaaaatgggcaaatggtctgaggttcctgacatccaggcattcttctacacatcagtcccgccctagtctctgctcccaatgcgactcatcccaaatctttcttctttctctcctgtgtgttccttcggtctccaccccaagctctgagtactttgaatcctccttttctgtggagccatctgacctctcccctgctcgccgggctgagccaggtcccaattcttccgcagcctctgttcccccactctataatccttctatcacttcccctcctcacacctagtccggcttatggttttgttccttgactagccctaccccacctgcccaacaatttcctcttaaagaggtggctggagctaaaggcatagtcaaggttgttgctcctgttttctttatccgacctctcccaaaacagttaggctctttttcatcaaatataaaaccccagcccagttcatggcccgtttggcaacaacccttaaacgccttaccgccctagacccagagaggccagaaggccgtcttattctcagtatgcattttattacccaacccactcctgacgttagaaaaagctccaaaaattggattccagccctcaaaccccacaacaggacttaaccttgccttcaaggtgtacaataatagagaagagtggcaattacttgcctctgctgtgagagaaacttcagccacatctccagcatacaagaatttcaaaacgcctaaaccgcagtggccaggcgttcttccaagacctcctaccccaggatcttgcttcaagtactgaaaatgtggccactgggccaaggaatgtctgcagcccggattcctcctaagcaatgtcccatctgtgcaggaccccactggaaattggactgtccaactcacctggcagccattcctagagttcctggaactctggcgcaaggctcactgactgactccttcccagatcttctcggcttagtggctgaagactgacactgcccgatcgccttggaagcctcctggaccatgatagatgctttaggtaactcttacagtggaggatgagtccatccccttcttaatacggaggctatccactgcacattaccttcttttcaagggcctctttcccttgcctccataacagttgtgggtattgacggccaggcttctaaacctcttaaaactccccaattctggtgccaactgggacagtattcttttatgcgctcctttttagttattcccgcctgcccagttcccttattaggtcgaggcattttaactaaattatctgcttccctgactattcctaggctacagccacacctcattgtcaccctttttcccagttcaaagcctccttcacatattttccttgtatctcctcaccttaatccacaagtatgagacatctctactccctccttggcaactgatcatgcaccccttaccatcccattaaaacctaatcacccttaccctgctcaacaccaatatcccatcccacagcacgctttaaaagaattaaagcctgttatcactcacttgttacagcatggccttataaagcctataaactctccttacaattcccccattttacccctccataacccattctgttctggatctcaaacatgctttctttactattcctttgcacctttcatcccagcctctcttcgctttcacttagactgaccctgacacccatcagcctcagcaacttacctgggctgtactggcgcaaggcttcagggacagcccccattacttcagtcaagcccaaatttcttcctcatccgttacctatctcggcataattcttcataaaaatacatgtgctctccctgctaatcatgtccagctaatctcccaaaccccaaccccttctacaaaacaactcctttccttcctaggcatggttaggtacttttgcctttagatacctggttttgccatcctaacgaaaccattcattctccccatttccccatattacctctttcctgttccccacccagaccacgcttggtttattgatgatagttcttccaggcccaatcgccaatcactggcaaaggcaggctatgctatagtgtcttccacatctatcactgaggctaccactctgcccccctccactacctctcagcaagccaaactcattgtcttaacctgggccctcactcttgcaaagggactgcatgtcaatatttatactgactctaaatatgccttccatatcccgtaccaccatgctgttatatgggctgaaagaggtttcctcactacacaagggtcctccatcattaatgcctctttaataaaaactcttctcaaggccactttacttccaaaggaagctggagtcattcactgcaagggccatcaaaaggcatcagatcgcgtcgctcagggcaatgcttatgctgataaggtagctaaagaagcagctagcattcctacttctgtccctcacggccagtttttctccttctcatcagtcactcctacttactctcccactgaagtttctacctatcaatccctccccactcaaggtaaatggttcttagaccaaggaaaatatctccttccagcctcacaggcccattctattctgtcgtcacttcataacctcttccatgtatgttataagctgctaacccgcctcttagaacctctcatttcctttccatcgtggaaatctattctcaaggaaatcgcttctctgtgttctatctgctattctactcctcagggattgttgaggccccctcccttccctacacatcaagctcggagatttgcccctgcccaggactggcaaattgactttactcgtatgccccgagtcaggaaactaacatacctcttggtctgggaagacactttcaccagataggtagaggcctttcccacagggtctgagaaggccaccgtggtcatttcttcccttctgtcagacataattccttggtttggacttcccacttctgtgcagtccaatagcggacgggcctttattagtcaaatcacccaagcagtttctcaggctcttggtattcagtggaaacttcataccccttatcgtcctcaatcttcaggaaaggtagaacggactaatggtcttttaaagacacacctcactaagctcagcctccaatttaaaaaggaccggatagtacttttaccactttcccttctcagaattagagcctgtcctcgagatgctacagagtacagcccatttgaacttttatatggatgccctttcttgctcggccccaacctcgtcccagacaccagccctctaggtgactatcttccagtcctccagcaggctagacaggaaatttgccaggctgctaatcttctcttgcctattccagattcccagccttatgaagacaccctatctggacgatcagttcttgttaagaatctgacccctcaaactctacaacctcgacggaccggaccctacttagtcatctataataccctaactgccgtcctcctgcaggaccctccccattgggttcaccgttccagaataaagccgtgtccattggacagccagcctgatctctcctcttccttctggaagtcgcgagtactcacccctacttcccttaaactcacccacatttctgaagaacagtagtaacccttatgagcctaatacatcccttcattttgttaggtctatccttccttaccagagtctttgcaacagggccttatgcagtcacccccactacttagactgcatcccaaaaacttttcatccctgctctcttctgtctagtcatactcctattcttcgttttcacctctccatacatgccctgcccttgtctacactgccagcttatacttttcctccaaaccatcatagctggtcctggtcttatcccctaactgccactcttaactccctcttggaatggataaatggcctttgctggaaaagcacactccacttctttcacccattttacatttccagtttcgccttacgcaaggtctcttcttcctctgtggctcctccacctgcatgtgtccacctgttaatgagacaggaacatgtacactagttttccttaccccaaaaatcaatttgcaaataagaccgagcagcttcctgttcccctcatgacaccaacacttcactattattttattttttcttattattaatataagaagacaggaataggccttgacttactcactgctgaaaaaggaagactctgtatatttttaaatgaagactgttgtttttacctaaatcagtctggcctggtatatgacaacataaaaaaattcaaggatagaggccaaaaactcaccagccaagcaaataatcatgctgaacccccttaggcactctctaatttgaagtcctgggtcctcccaattcttagtcctttaatacttgtttttctccttttcttattcggaccttatgtcttctgtttagtttctcagttcatacaaaaccatatccaggccatcaccaatcatcctatatgacaaatgctccttctaacaaccccagaatatcaccccttaccacaaaatcttccttcctcttaatctctcccactctaggttcccatgccacccctaatcctgctcgaagcagccctgagaaacatcacccattatctctccataccaccccccaaaattttccccaccccaacacttcaccactgtttgtttttcttattaatataagaagacaagaatgtcaggactctgagcccaagcctgcacatatacatccagatggcacgaagctactgaagaatcacaaaagaagtgaaaatggtcggttcctgccttaactgatgacattaccttgtgaaattccttctggctcagaagctcccccactgagcaccttgtgacccccgcccctgccctcaagagaacaaccccctttgactgtaattttccactacctacccaaatcctataaaactgccccagccctaacttcctttgctgactctctttttggacttagcccacctgcaattaaaaagctttattgctcacacaaagcctgttggtggtcccttcacacggacacacgtga

SEQ ID NO: 218 - DNA, 5700 bp, Homo sapiens
gtaaaaggatattaaccccagaggcaacaaaagaaattaaattagtggaagaaaaaattcagtcagcacaaataaatagatcccttagtctcactccaacttttgatttttgctactgcacattctccaacaggcatcattgttcaaaatactgatcttgtggagtggtcattccttcctcacagtacaattaagacttttacattgtacgtggatcaaatagctacattaattggtcagaaaaggttatgaatagtaaaattgtgtggaaatgacccagacaaaatagttgttcctttaaacaaggaacaggttagacaagcctttatcaattctggtgcatggcagattggtcttactaattttgtgggaattattgataatcattacccgaaaacaaaaatcttccagtttttaaaattgactacttggattctacctaaaattaccagacataaacctttagaaaatgctctgacagtgtttactgatggttccagcaatagaaaagcagcttacacagggccaaaagagcgagtcatcaaaactcaatatcaattggctcaaagagcagagttggttgcagtcattacagtgttacaagactttgatcaacctattaatattgtatcagattctgcatatgtagtgcaggctacaaaggatgttgagacagctctaattaaatatagcatagatgatcagttaaaccagcagttcaatttattacaacaaactgtaaaaaaaaaagaaatttcccattttatgttactcatattcgaggacacactaatttaccagggcctttaactaaagcaaatgaacaagctgacttactggtaccatctgcattcataaaagcacaagaacttcatgctttcactcatgtaaatgcagcaggattaaaaaacaaatttcatgttgtagggtccagccccatagggtcggtgggtctctccccatgtgcagagatgagagagtgtagaaataaagacacaagacaaagagataaaagaaaaggcagctgggcccgggggaccactaccaccaatgcacggagaccggtagtggccccaaatgtcgggctgcgctgttatttattggatacaaagcaaaaggggcagggtaaagcgtgtaagtcatctccagtgataggtaaggtcacgtgggtcacgtgtccactggacagggggcccttccctgcctggcagccgaggcagagagagagaggagacaaagagaaagacagcttacaccattatttttgcatatcagagacttttagtactttcactaatttactactgctttctagaaggcagagccaggtgtacaggatggaacatgaaggcggactaggagcatgaccaccgaagcacagcatcacagggagacggttaggcctccggataactgcgggcgagcctgactgatgtcaggccctccacaagaggtggaggagcagagtcttctctaaactcccccggggaaagggagactcccttccccagtctgctaagtagcgggtgttttcccttgacacttatgctaccgctagaccacggtccgcctggcaacgggcgtcttcccagacgctggcgtcaccactagaccaaggagccctctggtggccctgtccgggcataacagaaggctcgcactcttgtcttctggtcacttctcactgtgtcccctcagctcctatctctgtatggcctggcttttcctaggttatgattatagagcgaggattattataatattggaataaagagtaattgctacaaactaatgattaatgatattcatatataatcatgtctatgatctagatctggtataactattcttgttttatattttattatactggaacagctcgtgtccttgctctcttgcctcagcgcctgggtggcttgccgcccacagatgtcacatggaaacaggcaaaaaatattctacaacatggtacccagtgtcaagtcctacacctgcccactcaagaggcaggagttaatcccagaggtctgtgtcctaatgcattatggcaaatggatgtcacacatgtaccttcatttggaagattatgatgtgtccgtgtaacagttgatacttattcacatttcatgtgggcaacttgccagacaggagaaagtacttcccatgtgaaaaaacatttattgtcttgttttgctgtcatgggagttccagaaaaaatcaaaactgacaatggaccaggatattgtagtaaagctttccaaaaattcttaaatcagtggaaaattacacacacaacaggaattccctataattctcaaggacaggccatagttaaaaaaaactaatagaacactcaaaactcaattagttaaagagaagggggagacagtaaggagtgtaccactcctcagatgcaacttaatctagcattctatactttaaatgttttaaacatgtatagaaatcagactactacctctgcagaacatcttactggtcaaaagaacagcccacatgaaggaaaactgatttgataaaaagacaacaacaataagacatgagaaatagggaaggtggtaacttgggggagaggttttgcttgtgtttcaccaggagaaaatcagcttcctgtttagatacccactagacatttaaagttctacaatgaacccatcagagatgcaaagaaaagcacctccacggagatggaaacaccacaatcaaacaccatcgattcacaaggtgaacaaaatggtgatgtcagaagaacagatgaagttgccatccaccaagaaagcagagccgccgacttgggcacaattaaagaagctgacacagttaccaaaaaaaagcctagagaacacaaaggtgacacaaactccagagaacacgctgcttgcagctttgatgattgtatcaacggtggtaagtctccccttgcctgcaggggcagctgcagctaattatacctactgggcctatgtgcctttcccgcccttaattcgggcagtcacatggatggataatcctattgaagtatatgttaataatagtgcatgggtacctggccccacagatgatcgttgccctgccaaacctgaggaagaaggaatgatgataaatatttccactgggtatcgttatcctcctatttgcctagggagagcaccagcatgtttaatgcctgcaatccaaaattggttggtagaagtacctactgtcggtaccaccagtagattcacttatcacacggtaagtggaatgtctctcaggccacaggtaaattatttacaggacttttcttatcaatgatcattacaatttaggcctaaacaaaagccttgccccaaggtaattcccaaagaatcaaaaggcacagaagttttagtttgggaagaatgtgtggccgatagtgcggagatattacaaaacaatgaattcggaactattatagattggacatgtcgaggtcaattctaccacaattgcacaggacaaactcagtcatgtcccagtgcacaagtgagtccagctgttaacagtgacttaacagaaagtttagacaaacataagcacaaaaaattacagtctttctaccctttggaatggggagaaaaaggaatctctactccaagactaaaaataataagtcttgtttctggtcctgaacatccacaattatggatgcttactgtggcctcatattgcattagaatttgatctggaaatcaagctatataaagaagagatcgcaagccattttatactatcgacctaaattccagtctaacagttcctttgcaaagttgtataaagcccccttatatgctagttgtaggaaatatagttattaaaccagactcccaaactataacctgtgaaaactgcagattgtttacttgcattgattcgacttttaattggcagcaccatattctgctagtgagagcaagagaaggcgtgtgggtccctgtgtccatggactgaccgtgggaggcctcgccatccgtccatattttgactgaagtattcaaagccattttaaatagatccaaaatattctttaattgcagtgattatgggactaattgcagtcacagctacggcctctgtggcaggagtttcattgtactcttctgctcagacagtaaacttttttaattattggcaaaagaattctacaagattgtggaattcataatctggtattgatcaaaaattggcaaatcaaattaatgaccttagacacaatgttgtttggatgggagataggctcacgagcttgaaacatcatttctggttacactgtgactggaatatgtcacatttttgtattacatcctaagcctataatgagtctgagcatcattgggacatggttagatgccatctacaaggaagagaagatgatcttactttagacatttcaaaattaaaagaaaaatttttgaggcatcaaaaacccatttaaatttggtgccaggaactgaggcaatcgcgaaagctgctgatggcctcgcaaatcttaacccggtcacttgggttaaaaccatcgcaagttccactattgtaaatttcatattaatccttgtgttcctgttctgtctgttgttagtctgcaggtgtacccagcagctccgaagagacagcgaccattgagaatgggtgatgacgacgatggtggttttgtcaaaaagaaaagggggaaatgtggggaaaagaaagagagatcagactgttactgtgtctatgtagaaaaggaagacataagaaactccattttgatctgtattaagaaaaattgttctgctttgcgatgctgttaatctgtaactttagccccaaccctgtgctcacagaaacatgtgctgtattgaatcaaggtttaatggatttagggctgtgcagggtgtgccttgttaacaatatgtttgcaggcagtatgcccggtaaaagttatcgccattctccattctctgttaaccagggacacaatgcactgcggaaagccgcagggacctctgccctagaaagcctgggtattgtccaagtttccccccactgagacagcctgagatatggcctcatgggaaaagaaagaccttatatcccccaacccgacacccgtgaagggtctgtgctgaggaggagtagtgaaagagggaggcctctttgcagtcaagataagaggaaggcttctgtctcctgctcatttctgggaatggaatgcctcggtgtaaagccgaccattcattctattctgaggtaggagaaaaccgccctgtggttggaggtgagacatgctggcagcaatactgctctgtgactctttgctacactgagatgtttgtgtgaagagaaacataaatctagcctacgtgcacatccaggcacagtacctttccttgaacttattcatgacacagattcctttgctcacgtttccctgctgaccttctcgccaccatcaccctgttgccctgccacactcccctcacaaagatagtaaaaatagtgatcaataaatactgagggaactcagagaccagcgccggtgcgggtactcgcacactgagctccggttgtctgggcccactgctgtttctctatactttgtctctgtgtcttatttcttttctcagtttctcatctccacctgatgagaaacacccgcaggtgtggaggggcaggcccccttca

SEQ ID NO: 219 - DNA, 328 bp, Homo sapiens
tgagtcaggcacaaagtaagcccaccccactaggaactatgttgaaaaatttcaagaaaggatttaagggagactatggagtactatgacaccaggaaagcttaaaactttgtgtaagatagactggccagcattagaggtgggttggccatcagaaggaagcctggacaggtcccttgtttcaaaggtatggcacaacgtaacctgtaagccagggcacccagaccagttcccgtacatagacacttggttacagctggttttagacgccaccccccacccctcccaccacagtggttgagaaaacagcagcataagtggctggcag

SEQ ID NO: 220 - DNA, 238 bp, Homo sapiens
tacagttgatagctagtcagacacgagcaggataggagagggctccctgccctcaccaccaggaatgttgatggtggtgacggtcaggtggttgttaactgtctctgtaaagtaataattggttgcagccagtgccagggaagggcagtcttccagtagatagaaaacacctaaaactggtgatcagcagcttcctgataagacctcaggagttgggcaagtgggctcaggtgagcac

SEQ ID NO: 221 - DNA, 966 bp, Homo sapiens
gtggggaaaagagagagagatcacattgttactgtgtctgtgtagaaagaagtagacataggagactccattttgttctgtactaagaaaaattcttctgccttgagatgctgttaatctaaccctagccccaaccctgtgctccctgagacatatgctgtgtcaactcagggttaaatggattaagggctgtgcaagatgtgctttgttaaagaaatgcttgaaggcagcatgctcgttaagagtcatctccactccctaatctcaagtactcagggacacaaaacactgaggaaggccacagggacctctgcctaggaaagccaggtattgtccaaggtttctccccatgtgatagtctgaaatgtggcctcgtgggaagggaaagacctgaccgtcccccagcccgacacccgtaaagggtctgtgctgaggaggattagtaaaagaggaaggaacgcctctttgcagttgagacaagaggaaggcatctgtctcctgctcgtccctgggcaatggaatgtctcagtgtaaaacccgattgtatattccatctactgagataggggaaaactgccttagggctggaggtgggacatgctggcagcaatactgctcttcaagtcattgagatgtttatgtgtatgcatatctaaagcacagcacttaattctttaccttgtttatgatgcagagacctttgttcacgtgtttacctgctgaccttctctccactattatcctttgaccctgccacatccccctctccgagaaacacccaataatgatcaataaatactaagggaactcagaggccggtgggatcctccgtatgctgaacaccggtcccctggacccctttttttctttctctatactttgtctctgtgtctctttcttttccaagtctctcattccacctaacgagaaacaaccacaggtgtggaggggcagcccaacccttca

SEQ ID NO: 222 - DNA, 9462 bp, Homo sapiens
gtggggaaaagaaagagagatcagattgttactgtgtctgtatagaaagaagcagacataggagactccattttgttctgtattaagaaaaattcttctgccttgagatgctgttaatctataaccttacccccaaccccaggctctctgaaacacatgctgtgtcaactcagggttaaatggattaagggctgtgcaggatgtgctttgttaaacagatgcttgaaggcagcatgctccttaagagtcatcaccacgccctaatctcaactacccagggatacaaacactgcagaaggccacagggacctctgcctaggaaagccaggtattgtccaaggtttctccccatgtgatagtctgaaatatggcctcgtgggaagggaaagacctgaccgtcccgcagctcgacacccgtaaagggtctgtgctgaggaggattagtataagaggaaggcatgcctctttgcagttgagacaagaggaaggcatctgtctcctgcctgtccctgggcaatggaatgtctcggtataaaacccaattgtatgttccatctactgagataggggaaaaccgccttagggctggaggtgggacatgtgggcaacaatactgctctgtaaggcattgagatgtttatgtgtatgcatatctaaagcacagcacttaattctttaccttgtctatgatgcagagacctttgttcacctgtttatctgctgaccttctctccactattatcctatgaccctgccacatccccctctctgagaaacacccaaaaatgatcaataaatactaagggaactcagaggctggcgggatcctccgtatgctgaatgctggtcctctgggcccccttattcctttctctatactttgtctctgtgtctttttcttttccaagtctcttgttctacctaacaagaaacacccacaggtgtggaggggcaacccaccccttcatctggtgcccaatgtgggggcttttctctagggtgaaggtacgctcgagcatggtcattgaggacaagtcgacgagagatcccgagtacgtctacagtcagccttacagtgcgctcggacgaagctagggtgacaatggggcaaattaaaggaaaactaaaaataaatatgccttttatctcagctttattaaaattcttttaaaaagagtgggagttagagtatctacaaaaaatctaatcaagctatttcaaacaatagaacaattttgcccatggtttccagaacaaggaactttagatctaaaagaagactggaaaagaattggcaaggaactaaagcaggtaggaagggtaatatcattccacttacagtatggaatgattgggccattattaaagcagctttagaacgatttcaaagagaagaagatagtgtttcagtttctgatgcccctggaagctgtgtaatagattgtaaagacaagacagggaaaaaatcccagaaagaaacggaaagtttacattgcgaatatgtagcagagccagtaatggctcagtcaacgcaaaatgttgactataatcaatcaattacagggggtgatatatcctgaaacattaaaattagaaggaaaaggtccagaattagtggggccatcaaagtctaaaccacgaggaccaagtcctcttccagtaggtcagatgcccgtaacattacaacctcaaacgcaggttagagaaaataagacccaactaccagtagcttatcaatactggccaccggccaaacttcagtatcggccacccccagaaagtcagtatggatatccaggaacgctcccagcaccacagggcagggcgccataccctcagccacccactagcagacttaatcatacggcaccacctagtagacagggtagtgaattacatgaaattattgataagtcaagaaaggaaggagacactgaggcgtggcaattcccagtaacgttagaaccgataccacctggagaaggagcccaagagggagagcctctcacagttgaggccagatacaagtctttttcgataaaaatgctaaaagatatgaaagagggagtaaaacactatggacccaactccccttatatgaggacattattagattccattgctcatggacatcatagactcattccttatgattgggagattctggcaaaatcgtctctctcaccctctcaatttttacaatttaagacttggtggattgatggggcacaagaacaggtctgaagaaatagggctgccaatcctccagttaacaaagatgcagatcaactgttaggaacaggtcaaaattggagcactattagtcaacaagcattaatgcaaaatgaggccattgagcaagttagagctatctgccttagagcctgggaaaaaatccaagacccaggaaccgcctgcccctcatttcatacagtaagacaaggtttgaaagagccctaccctgattttgtggcaaggttccaagatgttgctcaaaagtcaattgctgatgaaaaagcccgtaaggtcatagtggagttgatggcatacgaaaacgccaatcctgagtgtcaatcagccattaagccattaaaaggaaaggtttccacaggatcagatgtaatctcagagtatgtaaaagcctgtgatggaattggaggagctatgcataaagctaagcttatggctcaagcaatagtgggagttgttttagaaggacaagttagaacatttggagggaaatgttataattgtggtcaaattggtcatttaaaaaagaattgcccagtctcaaataaacagaatataactattcaagcgactacaacaacaggtagagagccaccagacttatgtccaagatgtaaaaaaggaaaacattgggctagttaatgtcattctaaatttgatagaaatgggcaaccattgtcaggaaacgagcaaaggggccagcctcaggccccacaacaaactggggcattcccaattcagccctttgttcctcagggttttcagggacaacaacccccactgtcccaagtacctcagggaataagccagttaccacaatacaacaattgtcccccgccacaagtggcagtgcagcagtagatttatgtactatacaagcagtctctctgcttccaggggagcccccacaaaaaatccccacagggttatatggcctgctgcctgagggtactgtaggactaatcttgggaagatcaagtataaatctaaagggagttcaaattcatacttgtgtggttgattcagactataaaggcaaaattcaattggttattagctcttcaattccttggagtgccactccaggagacaggatttttccatttttactcctgccttatattaaggttggaaatagtgagataaaaagaacaggagggtttggaagcactgttccaacaggaaaggctgcatactgggcaagtcagatctcagagaacagacctgtgtgtaaggccattattcaaggaaaacagtttgaagggttggtagacactggggcagatgtctctatcattgctttaaatcagtggccaaaaaattggcctaaacaaaaggctgttacgggacttgtcggcgtaggcacagcctcagaagtgtatcaaagtactgagattttacattgtttagggccagataatcaagaaagtactgttcagccaatgattacttcaactcctcttaatctgtggggtcaagatttattacaacaatggggtgtggaaatcaccatgcccgctccattatatagccccacgagtcaaaaaatcatgaccaagatgggatatataccaggaaagggactaggaaaaaatgaagatggcattaaagttccagttgaggctaaaataaatcaagaaagagaaggaattagggtatccttgttaggggcggccactgtagagcctcctaaacccataccattaacttggaaaacagaaaaaccagtatgggtaaatcagtggccgctaccaaaacaaaaactggaggctttacattcattagcaaatgaacagttcaaaaagggacatattgagccttcattctcgccttggaattctcctgtgtttgtaattcagaagaaatccagcaaatggtgtatgttaactgacttaagggccgtaaatgccgtaaatcaacccatggggcctctccaacccggattgccctctctggccatgatcccaaagactggcctttaattataattgatctaaaggactgcttttttaccatccctctggcggagcaggattgcgaaaaatttgcctttactataccagccataaataataaagaaccagccaccaggtttcagtggaaagtgttacctcagggaatgcttaatagtccaactatttgtcagacttttgtaggtcgtgctctttaaccagttagagacaagttttcagactgttattcattatattgatgatattttgtgtgctgcagaaacaagagataaattaattgacttatacatttctgcaagcagaggttgccaacgcaggactggcaatagcatctgataagactcaaacctctactccttttcattatttagggatgcagatagagaatagaaaaattaagccacaaaaaatagaaataagaaaagacacattaaaaacactaaatgattttcaaaaattgctgggagatattaattggattcggccaactctaggcattcctacttatgccatgtcaaatttgttctctatcttaagaggagactcagacttaaatagtaagagaatgttaaccccagaggcaacaaaagaaattaaattagtggaagaaaaaattcagtcagcgcaaataaatagaacagatcccttagccccactccaacttttgatttttgctactgcacattctccaacaggcatcattattcaaaatactgatcttgtggagtggtcattccttcctcacagtacagttaagacttttacattgtacttggatcaaatagccacattaattggtcagacaagattatgaataataaaattatgtggaaatgacccagacaaaatagttgtccctttaaccaaggaacaaattagacaagcctttatcaattctggtgcatggcagattggtcttgctaattttgtgggaattattgataatcattacccgaaaacaaaaatcttccagtttttaaaactgactacttggattctacctaaaattaccagatgggaacttttagaaaatgttctaacagtatttactgatggttccagcaatggaaaagtggcttacacagggccgaaagaatgagtaatcaaaactccatatcaatcggctcaaagagcagagttggttgcagtcattacagtgttacaagattttgatcaacctatcaatattgtatcagattctgcatatgtagtacaggctacaagggatgttgagacagctctaatcaaatatagcatggatgatcagttaaaccagctattcaatttattacaacaaactgtaagaaaaagaaatttcccattttatattactcatattcgagcacacactaatttaccagggcctttgactaaagcaaatgaacaagctgacttactggtatcatctgcattcataaaagcatgagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgcgtcctaatgcattatggcaaatggatgtcacgcatgtaccttcatttggaagattgtcatatgttcatgtaacagttgatacttattcacatttcatatgggcagcttgcgaaacaggagaaagtacttcccatgttaaaaaacatttattatcttgttttgctgtaatgggagttccagaaaaaatcaaaactgacaatgggccaggatattgtagtaaagctttccaaagattcttaaatcggtggaaaatttcacatacaacaggaattccctataattcccaaggacaggccatagttgaaagaactaatagaacactcaaaactcaattagttaaacaaaaagaagggggagacagtaaagagtgtaccactcctcagatgcaacttaatctagcactctatactttaaattttttaaacatttatagaaatcagactactacttctgcagaacaacatcttactggtaaaaagaacagcccacatgaaggaaaattgatttggtggaaagataataaaaataagacatgggaaatagggaaggtgataacgtggggaagaggttttgcttgtgtttcaccaggagaaaatcagcttcctgtttggatacccactagacatttgaagttctacaatgaacccatcggagatgcaaagaaaagcacctccgcggagacggagacaccgcaatcgagcaccgtcgagtcacaagatgaacaaaatgatgatgtcagaagaacagatgaagttgccatccaccaataaggcagagccgctgacttgggcacaactaaacaagctgacgcagttagctacaaaatgtctagagaacacaaagatgacacaaactccagagagtatgctgcttgcagcattgatgattgtatcaacggtggtaagtctccctatgcctgcaggagcagctgcagctaattatacctactgggcatatgtgcctttcccgcccttaatttgggcagtcacatggatggataatcctatagaagtatatgttaatgagagtgtatgcgtacctggccccacagatgatcgctgccctgccaaacctgaggaagaagtgatgatgataaatatttccactgggtatcgttatcctcctatttgcctagggagagcaccaggatgcttaatgcctgcagtccaaaattggttggtagaaggacctactgtcagtcccatcagtagaatcatttcttacatggtaagtgggatgtcactcaggccacgggtaaattatttacaagacttttcttatcaaagatcattaaagtttagacctaaagggaaaccttgccccaaggaaattcccaaaggatcaaaaaatacagaagttttagtttgggaagaatgtgtggccaatagtgcggtgatattacaaaacaatgaatttggaactattatagattgggcaccttgggtcaattctaccatgattgcacagggcaaactcagtcgtgtcccagtgcacaagtgagtccagctgttgatagcgacttaacagaaagtttagacaaacataagcataaaaaattatagtctttctatccttgggaatggggagaaaaaggaatctctaccccaagaccaaaaataagaagtcctgtttctggtcctgaacattgagaattatggaggcttacttagcctcataccacattagaatttggtctggaaatcaaactttagaaacaagggattgtaagccattttatactatcgacctaaattccagtctaacggttcctttacaaagttgcgtaaagaccccttatatgctagttgtaggaaatatagttattaaaccagactcccaaactataacctgtgaaaattgcagattgtttacttgcattgattcaacttttatttggcagcaccgtattctgctggtgagagcaagagaaggcatgcggatccctgtgtccatggaccaaccgtgggaggcctcgccatccgtccatgttttgactgaagtattaaaaggcattttaaatagatccaaaagattcatttttactttaattacagtgattatgggattaattgcagtcacagctatggctgctatagcaggagttgcgttgcactcttctgttcagtcagtaaactttgttaatgattggcaaaagaattctacgagattgtggaattcgcaatctggtattgatcaaaaaatggcaaatcaaattaatgttcttagacaagctgtcatttggatgggagacaggctcatgagcttagaacatcgtttccagttacagtgtgactggaatacgtcagatttttgtattacaccccaagtttataatgagtctgagcatcactgggacatggttagacgccatctacagggaagagaagataatctcactttagacatttccaaattaaaagaacaaatttttgaaacatcaaaagcccatttaaatttggtgccaggaactgaggcaatcgcaggagttgctgatggcctcgcaaatcttaaccctgtcacttgggttaagaccatcggaagtactatgattataaatttcatattaatccttgtgtgcctgttttgtctgttgttagtctgcaggtgtacccaacagctctgaagagacagtgaccattgagaacgggccatgatgacgatggctgttttgtcgaaaagaaaagggggaaatgtggggaaaagaaagacagatcagattgttactgtgtctgcatagaaagaagtagacacaggagactccattttgttctgtattaagaaaaattcttctgctttgagatgctgttaatctgtaaccttaccccaaccccgtgctctctgaaacacatgctgtgtcaactcagggttaaatggattaagggctgtgcaggatgtgctttgttaaacagatgcttgaaggcagcatgctcctttagagtcatcaccacgccctaatctcaactacccagggacacaaacactgcggaaggccacagggacctctgcctaggaaagccaggtattgtccaaggtttctccccatgtgatagtctgaaatatggcctcgtgggaagggaaagacctgaccgtcccccagcccaacacccataaagggtctgtgctgaggaggattagtataagaggaaggcatgcctctttgcagttgagacaagaggaaggcatctgtctcctgcccatccctgggcaatggaatgtctcggtataaaacccgattgtatgttccatctactgagataggggaaaaccgccttagggctggaggtgggacatgtgggcaacaatactgctctgtaaggcattgagatgtttatgtgtatgcatatctaaagcacagcacttaattctttaccttgtctatgatgcagagacctttgttcacgtgtttatctgctgaccttctctccattattatcctatgaccctgccacatccccctctctgagaaacacccaagaatgatcaataaatactaagggaactcagaggctggtgggatcctccgtatgctgaatgctggtcccctgggcccccttatttctttctctatactttgtctctgtgtcttttttcttttccaagtctgtcattccacctaatgagaaacacccacaggtgtggaggggcaacccaccccttca

SEQ ID NO: 223 - DNA, 7330 bp, Homo sapiens
ctttgggtcccctcccttcgtatgagagctctgttttcactctattaaatcttgcaactgcactgttctggtccgtgtttgttacagctcaagctgagcttttgctcgccgtctaccactgctgtttgccgccatcgcagactcgctgctgacttccatctctccagatccggtaaggtgtctgctgtgctcctgatccagtgaggcacccattgctgctcccgattgggctaaaggcttgccattgttcctgcatggctaagtgcccgggttcatcctaatcgagctgaacactagtcactgggttccatggttctcttccataacccatggcttctaatagagctataacaatcaccgcatggcccaagattccattccttggaatccgtgaggccaagaaccccagatcagagaacatgaggcttgccaccatcttggaagcagcccgccgccatcttgggagctctgggagcaaggaccccaggtaacatttggtgaccacgaagggacttccaaagcggtgagtaatattagaccactttcacttgctattctgtcctattcttccttagaattggaggaaaatactgggcacctgtcgtccggttcgtctgtctggagccagcttccactttcaattttcttggagaaaccaagggccgactagaggcagaaagctgtcatcccgaactcctgacattagccggttgagatcatggcacagccagaagtctctacagtcgcccatgcgtgtgcccctacctttccctctgacccatacctcctgggtcccgaccacgactttcttgaaagtgtagccccaaaattctccttacctctgaatctgcttcctctgatccctgcctcctaggtactaatggttcagactttcatttcctctagcaagctgtatctcgaaagggatctaaggaagctctacgctgtgtcctgaggcatctagacataaacccagggagtcttatccctggtgtccctcctgatttaggtatacagctctcgatatgggcagttatgtgggacccgttccccaccacccttgccagggccccaagtttgtaatggctaagagaagagaaagagtgacagaggagagagagatggaagagagaaagagagatggaagagagagagagagagagagatggaggagagacagaggagagagagacagaggagagacagaggagatagagagagagagataaagagggagtcaaagagaaaaagaaaaagacagaaatagtaaacaaacaaacaaacaaaaaccagtgtgccctattcctttaaaagccagggtaaatttaaaacctatgattgataattgaaggtcttctccctgaccctataacattccaataccactttgttgtcagtgtaaataagggcgtagccgaaagcactgaggccaccgacaaccagtagccttcctatcaaaaatccttaacccaggaacccgcgggtggcccaaatgcattcaatctgtagcagcaactgctttgctaacagaagaaagtagaaaattagcctttagaggaaacctcattgtgagcacacctcaccagttcagaactatcgtaagtcaaaaaagcaaacaggtagcttactaactcaaaaatcttaaagtatgggtctattctgttagaaaaaggtaatttaacaccaaccactgataattcccttaacccagcagatttcctaacaggggatttaaatcttaattaccatacaaaggtccgaccagacctaggaggaactcccttcaggacaggacacagggtctcgctctgtcacccaggctggagtgcagtggtacaattatggcgctcactgcaacttcaactttccaggcccaagcaatccacccccctcacccccacaattagttgagggtacaggtgtgtgccaccatacctggttaatttttctttactttttgtatagacaggatctcactgtgttgcccaggctggtcgcaaactcctgggctcaagcgatcctcctgtcttggcctcccaaagtgctaggattacagatgtgagccaccacacctggccctgaccgatagatggttcctcccaggagactgagggaaaaaccacaacgggtattcagtaattgatagggagactcttgtggaagcagagttagaaaaattgcctaataattggtctcctcaaacgtgggagctgtttgcacttagccgagccttaaagtacttacagaatcaaaaaagactatctcaatcctgactcaaaaggttacccacaccctctctgaaacaaatttgcataagaactgttgtttatgggaatgaatcttgatggggcagctgggttgttatgaaatactcaggaacccagcccagctctaggactcacccctgagcacaaatgcaatgttgggcacgctggtaaaggaccactagaatccagcagcccggacccatttctttgtggtcaagaaagacggaaaaaggggtgcaggactgctacatcggtaagcgtaactaatccgataagcagaggtccatgggtggttacgcaccctggaagggaataaacattaggaccatagaggacgctctaggactaatgctcatcagaaaatgactaggggtgctggcatccctatgttcttttttcagatgggaaacattccccccaaggcaaaaacgcccctaagatgtattctggagaattgggaccaatttgaccctcagatgctaagaaagaaactacttatattcttctgcagtactgcctggccacaatatcctcttcaagggggagaaacctggcctcctaagagaagtataaattataacagcatcttacagctagacctcttttgtagaaaagaaggcaaatggagtgaagtgccatatgtgcaaactttcttttcattaagagacaactggcaattatgtaaaaagtgtgatttatgccctacaggaagccctcagagtctacctccctaccccagtgtccccctgactccttccccaactaataaggaccccccttcaacccaaatggtccaagaggagatagacaaaggggtaaacaatgaaccaaagagtaccagtattccccgattatgccccctccaagcagtaggaggaggagaattcggcccagccagagtgcatgtacctttatctctctcagacttaaagcaaattaaaatagacctaggtaaattctcagataaccctgatggctatattgatgttttagaagggttaggacaatcctttgatttgacatggagagatatgttactgctaaatcagacactaaccccaaatgagagaagtgccgccataactgcagcccgagagtttggtgatctctggtatctcagtcagctcaatgataggatgacaacagaggaaagagaatgattccccacaggccagcaggcagttcccactgtagaccttcattgggacacagaatcagaacatggagattggtgccgcagacatttgctaacttgcgcgctagaaggactaaggaaaactaggaagaagcctatgaattattcaatgatgtccactataacacagggaaaggaagaaaatccttctgcctttctggagagactaagggagacattgaggaagcatacctccctgtcacctgactctattgaaggtcaactaatcttaaaggataaatttttcactcagtcagctgcagacattagaaaaaaacttcagaagtcctccttaggcctggagcaaaacttagaaaccctattgaacttggcaacgttggttttttataatagagatcaggaggaacgggacaaacgggataaaaaaaaaagggccaccgctttagtcatggccctcaggcaagcggactttggaggctctggaaaagagaaaagctgggcaaatcgaatgctaatagggcttgcttccagtgcggtctacaaggacactttaaaaaagattgtccaagtagaagtaagccaccccctcgtccatgccccttatgtcaagggaatcactggaaggcccactgccccaggggacgaaggtcctctgagtcagaagccactaaccagatgatccagcagcaggactgagggtgcccggggcaagtgccagcccatgccatcaccctcacagagccccaggtatgctagaccattgagggccaggaggttaactgcctcctggacactggcacagccttctcagtcttactctcctgtcccggacaactgtcctccagatctgtcactatccgaggggtcctaggacagccagttactagatacttctctcagccactaagttgtgactggggagctttactgttttcacatgcttttctaattatgcctgaaagccccactcccttgttagggagagacattctagcaaaagcaggggccattatacacctgaacataggagaaggaacactcgtttgttgtcccctgcttgaggaaggaattaatcctgaagtctgggcaagagaaggacaatatggacgagcaaagaatgcccgtcctgctcaagttaaactaaaggagcccgcctcctttccctaccaaaggcagtacccccttagacccgaggcccaacaaggactccaaaagattgttaaagacctaaaagcccaaggcctagtaaaaccatgcaatagcccctgcaatgctccaattttaggagtacagaaacccaacggacagtggaggttagtgcaagatctcaggattatcaatgaggccgttgtccctctatacccagctgtacctaacccttatactctgctttcccaaatgccagaggaagcagagtagtttacagtcctggacctaaagggtgccttttgtgcatccctgtacatcctgactctcaattcttgttttcctttgaagatccttcgaacccaacgtctcaactcacctggactgttttaccccaagggttcagggatagcccccatctatttggccaggcattagcccaagacttgagccagttctcatacctggaccctcttgtcctttggtacgtggtgatttaattttagccactcgttcagaaaccttttgccactaagccacccaagcactcttaaatttcctcgccatctgtggctacaaagtttccaaaccaaaggctcagctctgctcacaacaggttaaatacttagggttaaaattatccaaaggcaccagggccctcagtgagaaacgtatccagcctatactggcttatcctcatcccaaaacactaaagcaactaagaggattccttggcataacaggcttctgccaaatgtggtttcccaggtacggcgaaatagccaggcctttatatacactaattaaggaaactcagaaagccaatacccatttagtaagatggacacttgaagcagaagcagctttccaggccctaaagaaggccctaacccaagccccagtgttgagcttgccaacaaggcaagacttttctttatatgtcacagaaaaaaccggaatagctctaggagtccttacacaggtccgagggatcagcttgtaatctgtggcgtacctgagtaaggaaattgatgtagtggcaaagggttggcctcattgtttactggtagtggcagcagtaacagtcttagtatctgaagcagttaaaatgatacaggaagagatcttactgtgtggacatctcatgatgtgaatggcatactcactgctaaaggagacttgtggctgtcagaaaaccgtttacttaaatatcaggctctattacttgaagggccagtgctgcgactgtgcacttgcgcaactcttaatccagtcacatttcttccagacaatgaagaaaaaaatagaacttaactgtcagcaagtaattgctcaaacctgcgccgctcgaggggaccttctagaggttcccttgactgatccccacctcaacttgtatactgatggaagtccctttgtagaaaaaggacttcgaaaagcagggtatgcagtggtcagtggtaatggaatacttgaaagtaattccctcactccaggaactagcgctcagctggcagaactaatagccctcacttgggcactaaaattaagggaagaaaaaaggtaaatatatatacagactcttaagtatgcttacctagtcctccatgcccatgcagcaatatagagagaaagggaattcccaacttccgagggatcacctatcaaacatcaggaagccattaggagattattattggctataaagaaacctaaagaggtggcagtcttacactgccaaggtcatcagaaaggaaaggaaagggaaacagaagggaatcgccaagcagatattgaagccaaaagagccgcaaggcaggaccctccattagaaatgcttatagaaggacccctagtgtggggtaatcccctccaggaaaccaagccccggtactcagaagaagaaatagaatggggaacctcatgaggacatagtttcctcccctcaggatggctagccaccaagaaggaaaaatacttttgcctgcagctaaccaatggaaattacttaaaacccttcaccaaacctttcacttaggcattgatagcacccatcagatggccaaatcattatttactggaccaggccttttcaaaactatcaagcagatagtcagggcctgtgaagtgtggcaaagaaataatctcctgcactgcaggccatatatttcaatccctctatctttaacctccttgttaagtttgtctcttccagaatcgaagctgtaaaactacaaatcattcttcaaatggagccccagatgcaatccatgactaagatctactgcggacccctggaccggcctgctagcccatgctccaatgttaatgacattgaaggcacccctcctgaggaaatctcaactgtacaacccctactatgccccagttcagcaggaagcagttagagtggttgttggccaacctccccaacagcacttgggttttcctgttgagaggggggactgagagacaggactagctgaatttcctaggccaactaagaatccctaaggctagctgggaaggtgaccacgtccacctttaaacacggggcttgcaacttagctcacatctgaccaatcagagagctcagtaaaatgctaattaggcaaaaacaggacgtaaagaaatagccaatcatcttatcacctgagagcacaatgggaaggacaatgatcgggatgtaaacccaagcattcgagccagcaacagctaccctctttgggtcccctccctttgtatgggagctctgtcttca

SEQ ID NO: 224 - DNA, 1971 bp, Homo sapiens
cccctttgggtctcctcccattttatgggagttctgttttcactttattaaatcttgcaactgcacactcttctggtccgtgtttgttacggctcgagctgagcttttgcttgccatccaccactgctgtttgccgccatcgcagaccctgacttccacccctctggatctggcagggtgtccgctgcactcctgatccagcgaggcacccattgctgccccctattgggctaaaggctcgccattgttcctgcatggctaagtgcctgggttcatcctaatcgagctgaacactagtcgctgggttccacggttctcttccatgacccatggcttctaagagagctataacactcaccacatggcccaagattccattccttggaatctgtgaggccaagaaccccaggtcagagaacaagaggcttgctgccatattgagagcagcaccaccatcttgggagctctaagaacaaggacccccacaccccgtaacattttggcgaccacaaagggacttccaaagcagtgaataatattggaccacttttgcttgctatcctgtcctatccttccttagaattggaggaaaataccaggcacctgtctgccagttaaaaatgattagcgtggctgctggacttaagactcaggtgtgaggctgtctgggagagggctttctaacaacccccaacccttctgggttggaagcctgatctgcctagaaccagcttccactttcaattttcttggggaagctaagggccgattagaagcagaaagctgttgtcctgaactcccggcattagccagttgagattatggcgcagccagaagtctctactcaacagttgcccatgcgtgcacccctacctttccttctgacccatacctcctgggtcctgaccatgaatttcttgaaagtgtagcctcaaaattctccttacctctgaatctatttcctctgatccctgcctcctagatactaatgcttcaggctttcacttcctctcccaagtattagagcaggttacatctccaaagggatataaggaagctctacactgcgtccttaggcccttaaactatgaacccagggagtcctgtccctggtgtccctcccaatttaagcatagagctctcgacatgggcagttatgtgggacctgttccccagcacccttgccagggccttagaactgataacccagtactttaacaactggaactgggtctacaacaacataataaatcaggatgaaagcaaatagagtaaataaaagggaggcacatattcctgtagtggcaaatgggggcaacgagtgaacgtccttccactgtgtttccaaaaatccatctacaaagacagaaaggagaaagtaagagagaaagagaaagatagaaggagtaaagaaaaacagtgtaacctatttctttaaaagccagggtaaatttaaacctataattgataactgaaggttttctccctggccctataacactccaataccactttgttgtcagtgtaaataagggcgtagcccgaaagctctgaggccactgacaaccagtagccttcgtatcaaaaatccttaacccaggaacctgcagttggcccaaatgcattcaatctgtagtggcaactgctttgctaacagaagaaagtagaaaattagcctttagaggaaacctcattgtgagcaaacctcaccagttcagaactatcctaagtcaaaaaagcaaaaaggtagcttactaactcaaaaatcttaaagtatggggctattctgttagagaaaggtaatttaacattaaccactgaaaattccattaacccagcagatttcccaacaagggatttcaatcttaattaccatacaaagatccaaccagacctaggaggaactcccttcaggacaggacaatagatggttcctcccaggtgattgagaaaaaaacacaatgggtattc

SEQ ID NO: 225 - DNA, 63 bp, Homo sapiens
gccttggaatttttgagctgtccttccccgcaccttgtttcattttgatacatgttttctaat

SEQ ID NO: 226 - DNA, 3168 bp, Homo sapiens
tcccacattattcctgataccacacctgacccccatgactgtatctttctgatctacctgacattcactccatttacccatatttcattctttcctgttcctcaccctgatcacacttggtttattgatggcagttccatcaggcctaattgtcactcattagcaaaggcaggctatgctatagtatcttccacatctatccttgatgttaccactctgtccacctccactacctgtcagcaagccaaactcattgccttaactcaggctctcactcttgcaaagggactacacatcaatatttatactgactctaaatatgccttccatatcctgcaccaccatgctgttatgtaggctaaaagaggtttcctcgctatgcaagtgtcctccatcattaatgcctctttaataaaaactcttctcaaggccactttacttccaaaggaagctggagtcattcactccaagggccatcaaaaggcatcagatcccatcactcaggacagtgcttatgctgataaggtagctaaagaagcagctagtgtcccaacttctgtccctcatggccagtttttctccttctcatctgtcactcccacctactctcccactgaaacttccacctatcaatctctttccacacaaggcaaatggttcttggaacaaggaaaatatctccttccagcctcacaggcctattctattctgttgtcattttgtaaccccttccatgtaagttgcaagctgctatcctgcctcttaaaacctctcatttcctttcctttgtaaaaatctatcctaaaaaaatcacttctctgtcccatctgctatactactactactcaggaattcctcaggccccctcccttccctacacatcaagctcgagaatttgccctgcccaggactggcaaattgactttactcacatgccccgagtcaggaaactaaaatacctcttggtctgggtagacactttcattggatgggtagaggactttcccacagggtctgagaaggccaccatagtcatttcttcccttctttcagacataattcctaggcttggccttcccacctctatacagtctgataatggaccggcctttattagtcaaatcacccaagcagtttctcaggctcttggtattcagtggaaccttcataccccttaccattctcaatcttcaggagaggtagaatggactaatggtcttttaaagacacatctcaccaagctcagcctccaacttaaaaaagattggacagtacttttacctcttgcctttctcagaattagagcctgtccttgagatgctagagggtacagtccatttaaacttttatatagacacactttcttgcttggccccaacctcgtctcagacaccagtcctctaggaatctatctgctggtcctccagcaggcaagacaggaaatttgccaagctgctaatcttttcttgcctactccatattcccagccatataaagacaccctagatggacgatcagttcttgttaagaatctgacccctcaaactctataaccttgatagaccggaccctacttagtcatctataataccccaactgccatccgcctgtaagaccctccctattaggctcaccattccagaataaagctgtgtccattggacagccagcctaatctctcctcttcctcctagaagttgcaagtactcaaccctacttcccttaaactcactcacatttctgaagaacagtagtaacccttatgagcctaaaacatcctttcattctattaagtttattaccctacttattgcaacaaggctttatgcagtcacccccactacttggactgcaaccccaaaacttgtcatccctactatcttctgtctagtcatactcctattcaccattctcaactactcgtaaatgccctgcccttgtttacactgccagtttacacttttcctccaaaccatcataactcatatctcctggttttacctcaaaccaccttccttaagtctctcttgaagtggatagaagatcttcagtgacaaggtacactccaatactttcaccctaataaagtcctattctttacctttatattcactcttattctcattcctgttcttatgcgaccctctacctctccccagctatctccaccacactatcaatctcattcactctctcctagctgtttctaatccttctttaaaaaatgattgctggctttgcatttctctttcctccaaaatcactgaggccttgacttactgctcaaaaaaaggggactgtgtgtatttttaaatgaaaagtgttgtttttacctaaatcaatctggcttggtatatgacaacataaaaaaactcaaggatagagcccaaaaactcatcaaccaagaaaataatcacgctgaacccccttaggcactctgattggatgtcctgagtcctcccaattcttagtcctttaatacctgtttttctccttctgttattgggaccttgtgtcttctgtttagtttctcaattcatacaaaactgtatccaggccatcaccaatcattctatgtgacaaatattccttctaacaaatccacaatatcaccccttaccacaaaatcttccttcagctttatctctcccactctaggttcccacgccacccctaatcccactcaaagcaaccctaagaaacatcacccagtaactctccataccaccccccaaaaaatttttcaccgccccaacacttcaacactattttgttttatttttcttattaatataaaaagacaggaatgtcaggcctctgagcccaagcctgcatgtatacatccagatggcctgaagcaactgaagaatcacaaaataagtgaaaatggctggttcctgccttagctgatgacatttgtgaaattcattctcctggctcagaagctcccccactgagcaccttgtgtcctccacccctgcccgccagagaacaaccccctttgacagtaattttccactacctacccaaatcctataaaactgccccacccctatctccctttgctgactctcttttcagactcagcctgcccgcacccaggttattaaaaagctttattgctcacacaaagcctgtttggtggtctcttcacatggacgtgtgtga

SEQ ID NO: 227 - DNA, 160 bp, Homo sapiens
tgaaatgtgtccaaaatgtaaaaaaggaaaacattgagctagtcagtgtcactctaagtttgataaagatgggaacccaatttcaggaaatgccatgaggtgccagcccatcccggcccccactccagactggggcatttccagctcaggccattccttc

SEQ ID NO: 228 - DNA, 362 bp, Homo sapiens
tgggtagctaggcagacatgagcagggcgggaaaggccccctaccccaggaatgtcaggcaaccatcaggtgatggtcaggtggttgttcgactgtctctctaaaataataattggtcacagctgggaggtgccagggaaaggcagcctcccagtagatgggaaacacctgaaactggtaccagccgcttcctgataagatctcaggagttgggtgagtgggccccagcctgttcactaagaggcaaaatggtggagtttaactggcacatgaccttcctctaggaacattcaactggtaagggaaaaatgcctcaaatgagcacgtacacaatcttcagtaaacacattgtgcatatggcc

SEQ ID NO: 229 - DNA, 403 bp, Homo sapiens
gtcaggcctctgagcccaagctaagccatcatatcccctgtgacctgcaggtaaacatccagatggccggtttctgccttaactgatgacattccgccacaaaagaagtgaaaatggcctattcctgccttaactgatgacattatcttgtgaaattccttctcctggctcatcctggctcaaaagctcccctactgagcaccttgtgaccccccattcctgcccccccagagaacaacccccctttttcctttacctacccaaatcctataaaacagccccacccctatctcccttcgctgactctcttttcggactcagcccgcctgcacccaggtgattaaaagctttattgctcacacaaagcctgttgggtggtctcttcacacggacgcacataaaa

SEQ ID NO: 230 - DNA, 6342 bp, Homo sapiens
gtcaggcctctgagcccaagctaagccatcatatctcctgtgacctgcacgtacacatccagatggctggttcctgccttaactgatgacattccaccacaaaagaaatgaaaatggcctgttcttgccttaactgatgacattatcttgtgaaattccttctcctggctcatcctggctcaaaagctcccctactgagcaccttgtgacccccactcctgccagagaacaacccccctttgactgtaattttcctttacctacccaaatcttacaaaacggccccaccccatcttccttcactgactctcttttcagactcagcccgcctgcacccaggtgaaataaacagccttgctgctcacacaaagcctgcttgttggtctctttacacagatgcgcatgaaatttggtgctgtgactcggatcggggggacctcccttgggagatcaatcccctgtcctcctgctctttgctccgtgaaaaagatccacctacgacctcgggtcctcagacccaccagcccaaggaacatctcaccaattttaaatcaggtaagccgcctcttcttaatctcttctccaacctctctcactatccctcaaccactttctcctttcaatcttggtaccacccttcaatctctcccttctcttaagttcagttcctttccttttctggtagagacaggagacgcgttttatccgtggacccaaaactccggcgctggtcacagactagggaagacagtcttcccttggtgtttaatcacgtggggacgactgcctgattactcacccacgtttcagaggtgtctgaccacacggggacgcctgccttggtccttcacccttagcagcaagtactgcttttctggggggcaagaacctcccaactccttctctctgtgtctctaccccttctctgctttttcaggggggcaagaaccccccaaccccttctccttcacccttagtggcaagtaccacttttctagggggcaagaaccccctgatcccttatttccatgccccaacctcttatctctgtgccccgatcccttaattccatgccctgacctcttatctttgcaccccaatcccttatttccatgccctgacttcttatctctgcaccccatcccttatttccacgccccaacctcttatctctgcgccctgatcccttatttctgtgccctgacctcttatctctgcaccccaaccccttatatctccatgccccgacccctttcctgcttttctggaaggtaagaacccccaaaccccttccctccgtgtctctactctgttctctgggcttgcttccttcactatgggcaaccttccaccctccattcctccttcttctcccttagcctgtgttctcaagaacttaaaacctcttcaactcacacttgacctaaaacctaaacaacttattttcttctacaatgccgcttgaccccaatacaaactcaacagtggttccaaatagacagaaaacggcactttcgatttttccatcctacaagatctagataattcttgttgtaaaataggcaaatggtctgaggtgcctgacgtccaggcattcttctacacgttgttccctccctagtctctgttcccaatgtgattcctccccaatcctccttctttccctcctggctgtcccctcagtcccaaccccaagcgtcgctgagtctttccagtcttccttttctacagacccatctgacctttcccctcctccccaggctgcttgtcgccaggccgagctaagtcccaattcttcctcagcctcagctcctccaccctataatccttctatcatctcccctcctcacacccagtctggcttacagttttgttccgcgactagccctcccctacctgcccagcaatttcctcttaggaaagtggctggagctaaaggcatagtcaaggttaatgctcctttttctttatccgacctctcccaaatcagttagcctttaggctctttttcatcaaatatgaaaaacccagcccagttcatggctcgtttggcagcaaccctgagacgctttacagccctagaccctaaaaggtcaaaaggccatcttattctcaatatacatttgattacccagtcagctcctgactttaaataaagctccaaaaattaaattccggccctgaaaccccacaacaggacttaattaacctcgccttcaaggtgtacaataatagaaaaaagttgcaattccttgcctccactgtgagacatatcccagccacatcaccagcacacaagaacttccaaacacctgaaccacagcagccaggagttcctccagaacctcctccccaagaagcttgctacaagtgccggacatctggccaccgggacaaggaatgcccgcagcccaggattcctcctaagccgtgtcccatctgtgtaggaccccactgaaaatcagactgttcaactcacctggcagccactcccagagcccctagaactctggcccaaggctctctgagtgactccttcccagatcttctcggcttagcagctgaagactgacactgcccgatcgcctcggaagccccctaaaccatcacggacgccgagcttcaggtaactctcacagtggaaggtaagtccgtccccttcttaatcgatatggaagctacccactccacattaccttcttttcaagggcctgtttcccttgcctccataactgttgcaggtactgacggccaggcttctaaacctcttaaaactccccaactctggtgccaacttagacaatactcttttaagcactcctttttagttatccccacctgcccagttcccttattaggccgacactttaactaaattatctgcttccctgactattcctgggctacagccacacctcatcgctgccttttcccccagttcaaagcctccttcacatcctccccttgtatctccccatcttaacccacaagtataagacacccctactccctccttagtgaccgatcctgcaccccttaccatcccattaaaacctaatcacccttaccctgctcaatgtcaatatcccatcccacagcacgcttcaaaaggattaaagcctgctattactcgcctgctacagcatggccttttaaagcctataaactccccttacaattcccccattttacctgtcctaaaaccagacaaggcttacaggttagttcaggatctgcgccttatcaaccaaattgttttgcctatctaccccgtggtgccaaacccatatactctcctatcctcaatacctccctccacaacccattattctgttctagatctcaaacatgctttgtttgctattcctttgcacccttcatcccagcctctcttcgctttcacttgtactgaccctgacacccatcaggctcagcaaattacttaggctgtactgctgcaaggcttcacagacagcccccattacttcagtcaagcccaaatttcttcctcatctgttacctatctcagcataattctcataaaaacacacgtgctctccctgattatcgtctccggctaatctcccaaaccccaatcccttctacaaaacaacaactcctttccttcctaggcatggttagtaaggtcagaattcttacacaagagctgggaccacgtcctatagcctttctgtccaaacaactggaccttactgttttaacccaaccctcatgtctgcatgcagcggctgccgctgccttaatacttttaaaggccctaaaaatcacaaagtatgctcaactgactctctacagttctcataacttccaaaatctattttcttcctcatacctgatgcatatactctctgctccctggctccttcagctatattcactctttgttgagtctcccacaattaccattgttcctggcacggacttcaacccggcctcccacattattctggataccacacctgaccctcatgactgtatctctctgatccacctgacattcaccccatttccccgtatttccttctttcctgttcctcaccctaatcacatttggtttattgatggcagttccaccaggcctaaatgccactcaccagcaaaggcaggctatgctatagtatcttccacatctatcattgaggctaccgctctgcccccctccactacctctcagcaagccgaactagttgccttaacccaagccctcactcttgcaaaaggactatgcgtcaatatttatactgactctaaatatgcctttcatatcgtgcaccaccatgcaagaagtttcctcactaaacaagggtcctctatcattaatccctctttaataaaaacgcttctcaacgccgcttaacttccaaaggaagctagagtcattcactgcaaggggcatcaaaaggcatcagatcccattgctctaggcgacgcttacgctgattaggtggctagacaagcagctagcattccaacttctgtccctcacagccagtttttctccttcacgtcagtcactcccacctactcccccactgaaacttccacctatcaatctcttcccacagaaggcaaatggttcttagaccaaggaaaatatctccttccagcctcacaggcccattctattctgtcgtcatttcataacctcttccatgtaggttacaagccgctagcccgtctcttagaacctctcatttcctttccatcctggaaatctatcctcaaagaaatcacttctcagtgttccatttgctattctactacccctcagggattgttcaggcctcctccctttcctacatatcaagctcggagatttgcccctgcccaggactggcaagttgactttactcacgtgccccgagtcagaaaactaaaatacctcttagtctaggtagacgctttcactggatgggtagaggcctttcctacagggtctgagaaggccaccgcggtcattttttcccttctgttagacataattcctcggtttggccttcccacctctatacagtctgatagcagaccggcctttattagtcaaatcagccaagcattttttcaggctcttggtattcagtgaaacctttatttcccttacggtcctcagtcttcaggaaaggtagaatggactaacggtcttttaaaaacacacctcaccaagctcagccaccaacttaaaaaggactagacaatacttttaccactttcccttctcagaattcaggcctgtcctcagaatgttacaaggtacagctcatttaagctcctgtatagatgctcctttttattaggccccagtatcattccaagaccaacttggactgtgccccaaaaaacttgtcatccctactatcttctgtctaatcatactcctattcactgttctcaactactcacacatgccctgctcttgtttacactgctggtttacactgtttctccaagccatcacagctgatatctcctggagctatccccaaactgccactcttaactcttgaagtaaataaataatctttgctggcagaactatgctgaacctccttaggcactctctaattaaatgtcctaggtcctcccaattcttagtcctttaatacctgtttttctccttctcttattccatttagtttttcaattcatacaaaaccgtatctaggccatcaccagtaattctaaatgacgaacgtttctcctaacagtcccacaatatcaccccttaccacaaaatcttccttcagcttaatctctcccattctaggttcccacaccgcccctaattccgctcgaagcagccctaagaaacatcgcccattatctctccgtaccatcccccaaaattttcgctgtcccaacacttcaccactattttgttttatttttcttattaatataagaagacaggaatgtcaggcctctgagcccaagctaagccatcatatctcctgtgacctacacgtacacatccagatggccggttcctgccttaactgatgacattccaccacaaaagaaatgaaaatggcctattcttgccttaactgatgacattatcttgtgaaattccttctcctggctcatcctggctcaaaagctcccctactgagcaccttgtgacccccactcctgcccgccagagaacaacccccctttgactgtaattttcctttacctacccaaatcttataaaacagctccaccccatcttccttcactgactcttttcagactcagcccgcctgcacccaggtgaaataaatagccttgttgctcacacaaagcctgtttggtggtctctttacacagacgtgcatgaaa

SEQ ID NO: 231 - DNA, 765 bp, Homo sapiens
gagagacaggactagctggatttcctaggccgactaagaatccctaagcctagctgggaaggtgaccacttccacctttaaacatggggcttgcaacttagctcacacctgaccaatcagatagtaaggggagctcactaaaatgctaattaggcaaaaacaggaggtaaagaaatagccaatcatctgttgcctgggagcacagcaggagggacaatgatcaggatataaacccaggtattcgagccagcaatggcaaccccctttgggtcccctccctttgtatgggagctctgttttcactctatttcactctattaaatcttgcaactgcactcttctgtgtttgttatggcttgagctgagctttcgctcacagtccaccactgctgtttgccacagtcacagacccgctgctcacttcaatccctccagatcccgcagggtgtccgctgtgctcctgatccagcgaggcacccattgccactcccgatcgtgctaaaggcttgccatttttcctgcatggctaagggcctgggttcatcctaatcgagctgaacactagtcactgggttctacagttctcttccatgacccacagcttccaatagagctataacactcaccgcatggcccaagattccattccttggaatccgtgaggccaagacccccaggtcagagaacacgaggcttgccaccatcttggaagcggctcaccaccatcttgggagctctgtgagcaaggaaccccagtaacaattt

SEQ ID NO: 232 - DNA, 152 bp, Homo sapiens
ttacagtaggtagctagtcaggcatgagcagggaaggagagcaccttgccaccacaccgctcactgctctcccaccaggaatgtcaggaaaccatcaggtgatagttaggcagttgtcacactgcctctctgaaataataattgtgttgcag

SEQ ID NO: 233 - DNA, 975 bp, Homo sapiens
aggtagctagtcaggcataagcagggcaggaggggctccctgctatacccctgccatacgtataccacgaatgtcaggtgaccatcaggtgatggtcaggcaattgttaactggctctttaaaataataattggtcacagccaacaccaggaaaaggaagaatacccaaaactggtcatcaacagctttctgataagatcccaggaattgggcaagttggctcaagcatgcacattaagaggcaaaatggcggagtttaactggtatatgaccttcctctaggaatgctagactggcaagggaagaacacctcaagtgagcatgtgtacaacttcagtaaacacactgcacatgctcttcttccaagcgctagcaggccactgcacatgcggacagcttaccccaaggaaagaatcaggggagaggtaaactgcaagaccccagaaatatgcaatgtataaaaccccaaggtggccaggcacggtggctcatgcatgtaatcccagcactttgggaggctgaggcgggtggatcacctgagatgaggagttcgagatcagcctggctaacatatgaaaccctatctctactaaaaacacaaaactaagttgggcgtggtggtgggtgcctgtaatcccagctactcaggaggctaaggcaggagagttccttgaacccgggaggcggaggtcgcagtgagccaacattgcaccattgcactccagcctgggtgacagagcaagactccatctcaaaacaaaacaaaacaaaaccccaagtcaaaagatcaaatggtgtgcttgatctctcgtctcctgcctggccctcttccacgtgtactttacttcctttcattcctgctgtaaagctttttaataaactttcactcctgctgtgaaacttgcctcagtctatccttctgttttatgcccctcagtagaattctttctttggaggaggcaagaattgaggttg

SEQ ID NO: 234 - DNA, 708 bp, Homo sapiens
gcaggcagtcaggcagacatgagcacagcaggagaggacacccccactccaaacccagcaatgtcaggcagccagcaggtgatgggcaggcgggtggctgttaagctgtctctctaaaatataattggtcacagccagtgccagggaaaggcagtttccccatagacaggaaaaacctgaaactggtgatcagcagcttcccaataagacctcaggagttgggtgagtgggctcaagcatgcaccctaagaggcaaaatggctgagtttcactggtctatgaccttcctctaggaaaacttgactggtaagggaagaacacctcaagtgagcatgcatacaatttcaggaaacacactgtgcatgcggcccctcccagatgctggaaggccactgtgcatgtggacagcccaccccatgggaagaatcaggggagaagggatgcaaccctccggaagcaggccaacctataaaaccccaagtccaaggtcaaactgcacttgatctctgaagtcgctgtgtggtcctcttccaagtgtactttacttcctttcattcctgctgtaaagcttttgaataaactttcattcctgctctaaaacttgcctcaatctcttcctgtgccttatgctccttggtagaattatttcttccgaggagacaagaattgaggttgctgtagactcatgtggatttgctgctgctaaaa

SEQ ID NO: 235 - DNA, 666 bp, Homo sapiens
tagagtaggtagttaggtggaaatgaacaggcaagagacccacaccccaccaggaatgtcaggcaaccataaagtggtggtcaggtggttgttaagctgtctctctaaaatagtaattggttgcagctagcaccagggaaagtcagtctcccaatagatagaaaacacctgaagccggtgatcagcagcttcccagtgagatctcaggagctgggcgagtaagcttaagcatgcacactaagaggcaagcaaaatggcagagtttaactggtatatgatcttcctataggaatactcgactgataaggaaaaaacatctcaagtaagcatgctgacaacttcagtaaactgcgcatgcggcccctcccaagtgctagcaggccactacctatgcagacagcccaccgcaagggaacaataagacacagaccctggaagcatgctaacatataaaaccccaagtcaaaaggtcaagtagtgcactcgaatctctcaagttgcccgcttggccctcttccaagtgcactttacttccttttactcctgctctaacactttttaataaattttcacttcttctctaaaacttgctttgatatctcctctctctctgccttattctcctcagtacaattatttctttggaggaggaaagaattgaggttg

SEQ ID NO: 236 - DNA, 980 bp, Homo sapiens
gtggggtaaagaaagagagatcggattgttactgtgtctttgtagaaaaggaagatataaggaactccattttgatctgtactaagaaaaattgtttctgctttgagatgctgttaacctgtaactttagtcccaaccctgtgctcacagaaacatgtgctgtattgaatcaaagttcaatggatttagggctgtgcgggctgtgccttgttaacaatatgtttgcacggcatatgcttagtaaaagtcatcgccatcctccattctcgattaaccagggacacaatgcactgcggaaagccgcaggaacctctgcccaagaaagcctgggaattgtccaaggtttcccccaactgagacagcctgagatatggcctcgtgggaaaggaaagaccttaccatcccccagcccgacaccagtaaagggtctgtgctgaggaggaggagtgaaagagggaggcctctttgcagttgagataagaggaaggcttctgcctcctgctcgtccctgggaatggaatgtctcggtggaaagctgacgattcccattcgttctgttctgagataggagaaaaccgccctgtggctggaggcgagatatgctggcagcaacactgctgtgttactctttgctacactgagatgtttgggtaaagagaaacataaatccagcctacgtgcacatccaggcacagtacctttccttgaacttattcgtgatacagattcctttgcttacgtttccctgctgaccatctccccacctgttgccctgctacactcccctcgctaaaatagtaaaaataatgatcaataaatactgagggaactcagaggctggtgccgctgtgggtcctccgtatgctgagcgccggtccccttagcccactgttctttctctgtagtttgtctctgtgtcttatttcttttctcagtccctcgtcccacctgacgagaaatacccacaggtgtgaaggggc

SEQ ID NO: 237 - DNA, 993 bp, Homo sapiens
gagctcggctgttggagacgtgagtcttgctgaagctcctggccgaataaagcccttccttctttaactcggtgtctgaggggttttgcccgtggcttgttctgctacatttcttggttccctgaccgggaagcgaggtgattaacagacagtcggacggtcgaggcagccccttaggtggcttaggcctgccctgtggagcatccctatggggcactccagccagcttggccgatgcggatcctgagagcactcctgggtaggcaattggcctggtggaacgcctcgccagaggagcacgtggcaggcccccgtggacgatcaacgcagtggctgaacaccgggaaggaactggcacttggagtctggacatctgaaacttggtaagactagtctttggaacttgcccactccatttgagtggaagcgtggcctgatcacccacggtctgcctgtaccggcactttggtttttgtttttgacttgacttggattgcttgatactttggttttgtttttgacctggcttggatttctggatactctgattttggttttgattctgagtttggtgtaaactgtaaaagtgtgtgtgtgtgccctttttactcgttctttgttttgtggtgtgagcatggtgttttgtctcgaagaagcatgggtcaggcacaaagtaagcccaccccactaggaactatgttgaaaaatttcaaggaaggatttaagggagattatggtgttactatgacaccaggaaaacttagaactttgtgtgaaatagactggccagcattagaggtgggttggccatcagaaggaagcctggacaggtcccttgtttcaaaggtatggcacaaggtaacctgtaagccagggcacccagatgagttcccatacatagacccttggttacagctggttttagaccccacacccccctcaccagtggttgagagaacagcagcataagtggctggcagagacaaggaaaga

SEQ ID NO: 238 - DNA, 397 bp, Homo sapiens
gtcaggcctcagagcccaagctaagccatcatatctcctgtgacctgcacatatacatccagatggcctgaagtaactgaagaatcacaaaagaagtgaaagtggcccgtttctgccttaactgatgacattaccttgtgaaattccttctcctggctcatcctggctcaaaagctcccccactgagcttgtgacccccatcactgccagccagagaacaaccccttttgactgtaattttcctttacctatccaaatcctataaaacggccccacccctatctccctttgctgactctcttttcggactcagcccgcctgcacccaggtgaaataaacagccttgttgctcacacaaaacctgtttggtggtctcttcacatggacgcaagtgaaa

SEQ ID NO: 239 - DNA, 1152 bp, Homo sapiens
tgagcccttaaaagggacaggaattgctcactcagggagctcggctcttcagacaggagtcttgccaatgctcctggttgaataaacctcttccttctttaactcagtgtctgaggagttttgtcttaggttcgtcctgctatatttcttggttccctgactgggaagtgaggtgattggcggatggttgcggcagctccttatgcagcttaagcctgccctgtggaacatccctgcgggggactccaaccagcccaagcaacgcagatcctgagagtgctcccgggtaggcatttgccctggtgggatgcctcaccagagcagtgtgtggcaggctcccatggaggatcaatgcagtggctaaacaccgggaaggaactagtacttggagtccggacatctgaaacttggtaagactagtctcgagaacttgcccactccatttgagtggaagcatggactgatcacccacagcgtgcctttatctgcactttggttttggttttggttttgacttggtttaaattgcttgacaggactggtcttgggaacttgcctactccatttgagtggaagcgtggcctgatcacccacggtgtgcctgtaccagcactctggtttttgtttttgacttgacttggattgtttgatactttggttttggttttgacctggcttggatttctggatactctgattttggttttgattttggtttggtgtaaactgcaaaagtgtgtgtgtgccctttttacccgttctttgttttgtggtgtgcgtgtggtttgagcatggtgttttgtctcgaagaagcatgggtcaggcacaaataagcccaccctactaggaactatgttaaaaaatttcaaaaaaggatttaaaggagactatggagtactatgacaccaggaaaatgtaaaactttgtgtaaaacagactggccagcattagaggtggattggccatcagaaagaagcctggataggtcccttgtttcaaaggtatggcacaaggtaacctgtaaagccagggcacccagaccagttcccttacacagatgcttggttacagctggttttagatctctccacagtggttgagagaactgcagcataagccaggctgagagagagagagagagagacagagaag

SEQ ID NO: 240 - DNA, 6308 bp, Homo sapiens
gtcaggcctctgagcccaagccaagccatcgcatcccctgtgacttgcacctatatgcccagatggcctgaagtaactgaagaatcacaaaagaagtgaaaatgccctgccccgccttaactgatgacattccacctcaaaagaaatgtaaatggctggtccttgccttaagtgatgacattaccttgtgaaagtctttttcctggctcatgatggctcaaaaacacccccactgagcaccttgcgacccccaaccctgcccaccagagaacaaatcccctttgactgtaatttttctttatctgcccaaatcttataaaacggccccacccctatctcccttcgatgactgtcttttcggactcagcctgcctgcccccctgtgaaataaacagccatgttgctcacacaaagcctgtttggtggtctcttcacacggatgcgagtgaaatttggtgctgtgactcagatcaggggacctcccttgggagatcaatcccctgtcctcctgttctttgctcggtaagaaagatccacttatgacctcaggtcctcagaccgaccagcccaagaaacatctcaccaatttcaaatccggtaagcggcctctttttactctcttctccaacctccttcactatccctcaacctctttctcctttcaatctcggcaccacacttcaatctctcccttcttttaatttcaattcctttcattttctggtagagacaaaggagacacattttatccgtagacccaaaactccggcgctggtgatagactgggaaggcagccttcccttggtgtttaatcattgcagggacacctctctgattattcacccacgtttcagaggtgtcagaccacgcagggacgcctgccttggtccttcacccttagcagcaagtcccacttttctgggggaggggcaagtaccccaaccccttctctctgtgtctctaccccttttccacctttctggggggcaagaaacccccaaccccttctccttcacccttagcggcaagtcctgcttttctaggggaggggcaagtaccctaaccccatatatctctgtgccccgatcccttatttctgtgccccaacctcttatatctctgtgccccaatcccttatttctatgccccgacctcgtatctctgtgccccgacccctttcccacttttctggagggtaagaacccccaaaccccttccctccatgtctctactctctcttttctctgggcttgcctccttcactatgggcaaccttccaccctccattcctccttctccctttgcctgtgttcttaagaacttaaaacctcttcaactctcaaatgacctaaaatctaagcatcttattttcttctgcaatgccacttgaccccaatacaaactcgacagtagttccaaatagccagaaaatggcactttcaatttttccatcctgcaagatctaaataattcttgtcataaaatgggcaaatggtctgaggtgcctgacgtccaggcattcttttacacattggtccctctctagtctctgttcccaatgcaacagatcccaaatcttccttctttccctcccacctgtcccctcagtcccaaccccaagcatcgctgagtctttctaatcttccttttctacagacccatctgacctctcccctcctccccaggctgctcctcgccaggccgagctaggtcccaattcttcctcagcctccgctcctccaccctataatccttttatcacctcccctcctcacacctggtccggcttacagtttcattccatgactagccctcccccacctgcccagcaatttactcttaaaaaggtggctggagctaaaggcatagtcaaggttaatgctcctttttctttatcccaaatcagatagcgtttaggctctttttcatcaaatataaaaatccagcccagttcatgactcctttggcagcaaccctgagacactttacagccctagaccctaaaaggtcaaaaggccgtcttattctcaaaatacattttattacccaatctgctcccgacattaaataaaactccaaaaattaaattctggccctcaaaccccacaacaagatttaattaacctcgccttcaaggtatacaataatagaaaaaagttgcaattccttgcctccactgtgagacaaaccccagccacatctccagcacacaagaacttccaaatgtctgaaccacagcggccaggcattcctccagaacctcctcccccaggagcttgcttcagaaatctggccacaaggccaaggaatgcctgcagcccaggattcctcctaagctgcgtcccatctttgtgggaccccactggaaattggactgtccaactcacctggcagccactcccagagtccctggaactctggcccaaggctctctgactgactccttcccagatcttctcggcttagcggctgaagactgacactgcctgatcgcctcggaagccccctagaccatcacggacgccgagcttcaggtaactctcacagtggaaggtaagcccgtccccttcttaatcaatacggaggctacccactccacattaccttcttttcaagggcctgtttcccttgcctccataactgttgtgggtattgacagccaggcttctaaacctcttaaaactccccaactctggtgccaacttagacaatactcttctaagcactccttttaattatccccacctgcccagttcccttattaggctgagacactttaactaaattatctgcttccctgactattcctggattacagctacatctcattgctgcccttcttcccaatccaaagcctcctttgcgtcctcctcttgtatccccccaccttaacccacaagtataagatacctctactccctctttggtgaccgatcacgcaccccttaccatctcattaaaacccaatcacccttaccctgctcaatgccaatatcccatcccacagcatgctttgaaaggattaaagcctgttatcactcgcctgctacagcatggccttttaaagcctataaactctccttacaattcccccattttacctgtcctaaaaccagacaagccttacaagttcgtttaggatctatgccttatcaaccaaattgttttcctaaccaccccatggtgccaaacccatatactctcctatcctcaatacctccctccacaatccattattctgttctggatctcaaacatgctttctttactattcctttgcacccgtcatcccagcctctcttcgctttcatttggactgaccctgacacccatcaggctcagcaaattacctgggctgtactgccgcaaagcttcacagacagcccccattacttcagtcaagcccaaatttcttcctcatctgttacctatctcatcataactctcataaaaacacacgtgctctccctgccaatcgtgtccgactgatctctcaaaccctagcaccttctacaaaacaacatctcctttccttcctaggcatggttatcgtggtcagaattcttacacacaagagccagtaccacaccctgtagcctttctgtccaaacaacttgaccttactgttttagcctagccctcatgtctgcgtgcagtggctgccgctactttaatacttttagaggccctcaaaatcacaaactatgctcaactcactctttacagttctcataacttccaaaatctattttcttcctcatacctgacgcatatactttctgcttcccggctccttcagctatactcactgtttgttgagtctcccacaattaccgttgttcctggcccgaacttcaatccagcctcccacattattctggataccacacctgaccctcatgattgcatctctctgatccacctgacgttcaccccatttccccacatttccttcttccctgtttctcaccctgatcacacttggtttattgatggcagttccaccaggcctaattgccactcaccagcaaaggcaggctatgctatagtatcttccacatctatcattgaggctaccactctgcccccctccactacctctcagcaagccaaactagttgccttaactcaagccctcactcttgcaaaaggactacgcgtcaatatctatactgattctaaatatgcctttcatattctgcaccaccatgcggtcatatgggctgaaagaggttttctcactacacaagggtcctccatcatgaatgcctctttaataataactctactcaaggccgctttacttccaaaggaagctggggtcattcactgtaaggggcatcaaaaggcatcagatcccattgctctaggcaacgcttgtgctgataaggtggctagacaagcagctagctctccaacttctgtccctcacggccagtttttctccttcacatcggtcactcccacctactcccctgctgaaacttccacctatcagtctcttctcacacaaggcaaatggttcttagaccaaggaaaacatatccttccagcctcacaggcccattctattctgtcgtcatttcataacctcttccatgtaggttacaagccgctagcccgtctcttagaacctctcatttcctttccatcatagaaatctatcctcaaggagatcactgctcagtgttccatctgctattctactacccctcatggattgttcaggcctcctcccttccctacacatcaagctcgaggatttgcccccacccaggactggcaaattgactttactcacatgcctcgagtcagaaaactaaaatatctcttagtctgggtagacactttgactggataagtagaagcctttcctacagggtctgagaaggccaccgcagtcatttcttcccttctgtcagacataattcctcagtttagccttcccacctctgtacagtctgataacagaccagcctttattagtcaaatcagccaagcagtttttcaggctgttagtattcagtgaaacctttatatcccttacagtcctcagtcttcaggaaaagtagaacagactaatggtcttttaaaaacacacctcaccaagcttagccaccaacttaaaaaggactggacaatacttttaccactttcgcttctcagaattcaggcctgtcctcggaatgctacaaggtacagcccatttaagctcctgaataagacactcctttttattaggcctcagtctcattccagacaccagagcaacttagactgtgccccaaaaaacttatcatccttactatcttctgtctagtcatactcctattcactgttctcagctactcatacatgccctgctcttgtttacactgccagtttacactgtttctccaagtcatcacagctgatatctcctggtgctatccccaaactgccactctaaactcttgaagtaaataaataatctttgctggcaggactatgctgaatctccttaggcactctctaatcagatgtcctgggtgctcccaagtcttagaccttttatacctgtttttctccttctcttattccatttagtttttcaattcatacaaaaccatatccaggccatcaccaataattctacatgacaaatgtttcttctaacaaccccacaacatcaccccttaccacaaaatcttccttcagtttaatctctcccactctaggttcccacgctgccccaatcccgctcgaagcagccctgagaaatgttgcccattctctctctccatactaccccccaaaaatttttgctgcccccacacttcaacactattttgttttatttttcttattaatataagaaggcaggaatgtcaggcctctgagcccaagccaagccatcgtatcccctgtgacttgcatgtatatgccgagatggcctgaagtaacagaagaatcacaaaagaaatgaaaatgccctgccctgccttaactggtgatattccaccacaaaagaagtgtaaatggccggtccttgccttatatgatgacattaccttgtgaaagtctttttcctggctcatcaagctcccccactgagcaccttgcgacccccactcctgcccaccagagaacaaaccccctttgactgtaattttcctttacctgcccaaatcttacaaaatggccccacccctatctcccttcgctgactctcttttcggactcagcccacctgcacccaggtgaaataaacagccatgttgctcacacaaagcctgtttggtggtctcttcacacggacgcgcatgaaa

SEQ ID NO: 241 - DNA, 5979 bp, Homo sapiens
gtcaggcctctgagcccaagctaagccatcatatcccctgtgacctgcatgtacacatccagatggccggttcctgccttaactgatgacattccaccacaagagaagtgaaaatggcctcttcctgccttaactgatgaaattgtcttgtgaaattccttctcctggctcatcctggctcaaaagctcccctactgagcaccttgtgacccccactctgcccaccagagaacccccctttgactgtaattttcctttatctacccaaatcctataaaatggccccacccttatctccctttgtcaggcctctgagcccaagctaagtcatcatatcccctgtgacctgcacatacacatccagatggccagtgcctgccttaactgatgacattccaccacaaaagaagtgaaaatggcctgttcctgccttaactgatgacattgtcttgtgaaattcctactcctggctcaacctggctcaaaagctccctcactgagtaccttgtgacccccactcctgcctaccagagaacaaccccccttcttcctttacctacccaaatcctataaaatggccccaccccatctcccttcgctgactctcttttcagactcagcccacctgcacccaggtgaaataaacagttttattgctcacacaaagcctgtttggtggtctcttcacacaggcgcacatgaaatttgatgccgtaactcggatcaggggacctcccttgggaacatcaatcccctgtcctcctgctctttgctctgtgagaaagatccacctacgacctcaggtcctcagactgaccagcccaagaaacatctcaccaatttcaaatccggtaagtggcctctttttactctcttctccaacctccctcactatccctcaacctctttctcctttcaatcttggtgccacacttcaatttctcccttcttttaatttcaattcctttcattttctggtagagacaaaggagacacattttatctgtggacccaaaactccggcgccggtcacggactagggaaggcagacttcccttggtgtttaatcattgcaggacacctctctgattattcacccacgtttcagaggtgtcagaccatgcagggatgcctaccttggtcctttacccttagcggcaagtcccgcttttctggggaagaggcaagtaccccaaccccttctctccgtgtctctaccccttctctgcctttctggggggcaagaaacccccaaccccttctccttcacccttagcagcaagtcccgcttttctgggggaggggaaattaccccaaccccttatatctctgcaccccgatcccttatttccatgccccaacctcttatatctctgtgccccgatcccttatttctgcatcccaacctcatatctctgcaccccaatcccttgtttatgcgccctgacttcgtatctctgtgccctgacccctttcccacttttctggagggtaagaacccccgaaccccttccctgcatgtctctactctctcttttctctgggcttgcctccttcactatgggcaaccttccaccttccattcctccttcgtctcccttagcctctgttcttaagaacttaaaacctcttcaactctcacctgacctaaaatctaagcatcttattttcttctgcaatgctgcttgaccccaatacaaatttgacagtagttccaaatagccagaaaatggcgctttcaatttttccatcctgcaagacctaaataattcttgtcataaaacaggcaaacagtctgaggtgcctgacgtccaggcattcttttacacatcggtcccttcctagtctctgtgcccaatgcaactcatcccaaatcttccttctttcccttctgcctgtcccctcagtcccaaccccaagcatcactgagtctttctaatcttccttttctacagacctatctgacctctcccctcctggccaggctgagctaggtcccgattcttcctcagcctctgctcctccaccctataatccttttatcacctcccctcctcacacccggtgcggcttacagtttcgttccatgactagccctcccccacctgctcagcaatttcctcttaaaaaggtgactggagctaaaggcatagtcaaggttaatgctcctttttctttatcccaaatcagatagcgtttaggctctttttcatcaaatataaaaatccagcccagttcatgactcgtttggcagcaaccctgagatgctttacagccctggaccctaaaaggtcaaaaggccatcttattctcaaaatacattttattacccaatctgctactgacattaaataaaactccaaaaattaaattccagccctcaaaccccacaacaggatgtaattaacctcgccttcaaggtgtacaataatagaaaaaagttgcaattccttgcctccactgtgagacaaaccccagccacatctccagcacacaagaacttccaaatgcctgaaccgcagcggccagacattcctccagaacctcctcccccaggagcttgctacaagtgccagaaatctgaccaccaggccaaggaatgcctgcagcccaggattcctcctaagccgtgtagcatctgtgcgggaccccactgaaaatcagactgttcaactcacctggcagccactcctagagcccctggaactctggcccaaggctctctgactgacgccttctcggattaacggctgaagactgatgctgcccgatcaccttggaagccctgtagaccatcatggatgccgagcttcaggtaactctcacagtggaaggtaagtccgtccccctagtcaatatggaggctacccactccacattaccttcttttcaagggcctgtttcccttgcctccataactgttgtggctattgacggccaggcttctaaaccgctgaaaactcccccactctggtgcgaacttggacaacactcttttatgcacttttttttagtcatccccacctgcccagttcccttattaggccgagatattttaaccaaattatctgcttccctgactattcctggactacagccacgtctcattgccgcccttcttcccagtccaaagcccccttcgcctcttcctctcatatccccccaccttaacccacaagtatgggacatctctactccttccctggcaaccaatcacatgcccattaccatcccattaaaacttaatcacccttaccccgctcagcgccaatatcccatcccacagcacgctttgaaaggattaaagcctgttatcacttgcatgctacagcatgggcttctaaaacctataaactctccgtacaattcccccattttacctgtccaaaaaccagacaagtcttacagattagttcaggatctgcgccttatcaaccaaattgttttgcctatccatcctgtggtgccaaacccgtacactcttttgtcctcaataccttcctccacaactcactattccgtgcttgatcttaaagatgctttttccactattcccctgcaccccttgtcccagcctctctttgctttcacttagactgaccctgacacccattaggctcaacaaattacctgggctgtactgccacaaggcttcacagacagcccccgttacttcagtcaagcccaaatttcatcctcatctgttacctatcttggcataattctcataaaaacacacgtgctttccctgctgatcatgtccaattaatctcccaaacctcaatcccttacaaaacaacaatgcctttgcttcgtaggcatggttagtgcggtcagaattcttacacaagagccaggactgcaccctgtagcctttctgtccaaacaacttgaccttactgttttagcctagccctcatgtctccatgcagtggctgctgccaccctaatatttttagaggccctcaaaatcacaaactatgctcaactcactctctacatttctcataacttccaaaatctattttcttcctcatacctgatgcatatactttctgctccccggctccttcagctgtactcactctttgttaagtcccacaattaccattgttcctggcccagacttcaatccggcctcccacattatttctgataccacacctgaccctcatgacggtatctctctgatccacctgacattcaccccattcccccatatttccttctttcctgttcctcaccctgatcacgcttgatttattgatggcggttccaccggacctaatcgccacacaccagcaaaggtaggctatgctatactacaagccactagcccgcctcttagaacctctcattttctttccatcgtggaaatctatcctcaaggaaataacttctcagtgttccatctgctattctactactcctcaggaattattcaggccccctcccttccctacacatcaagctcgaggatttgcccccacccaggactggcaaattagctttactcaacatgccctgagtcagataactaaaatacctcttagtctaggtagacactttcactggataggtagaggcctttcctacagggtctgagatggtcaccagtcatttcttctcgtctgtcagacataattcctcagttcagccttcccacctctatacagtctgataacagaccagcctttattagtcaaatcagccaagcagtttttcaggctcttagtattcagtgaaacctttatatcccttacagtcctctgtcttcaagaaaagtacaacggactaaaggtcttttaaaaacacacctcaccaatctcagccaccaacttagaaaggactggacaatacttttaccactttcccttctcagaagtcagacctgtcctcagaatgctacaaggtacagcccatttgagctcctgtatagacgctcctttttattaggccccagtctcattccagacaccagactaacttagactgtgccccaaaaaaacttgtcatccctactatcttctgtctagtcatacttctattcaccattctcaactaatcatacatgccctgctcttttttactctgccggtttacactgtttctccaagccgtcacagctgatatctcctggtgctatccccaaactgccactcttaactcttgaagtaaataaataatctttgctggcaggactatgctgaatctccttaggcactctctaatcagatgtcctgggtcctcccaattcttagtcctttaatacctgtttttctccttctcttattccgtttagtttctcaattcatacaaaactgtatccaggccatcaccagtaattctgaatgacaaatgtttcttctaacaaccccacaatatcaccccttaccagaaaatcttccttcagcttaatctctcccactctaggttcccacgacgcccctaatcctgctccaagcagccctgagaaacatcgcccattatctctccataccacccccaaaacattttcaccgtctcaacactttaccactatttcgttttatttttcttattaatataagaagacaggaatgtcaggcctctgagcccaagctaagccatcatatcccctgtgacctgcagatacacatccagatggccggtgcctgccttaactgatgacattccaccacaaaagaagtgaaaatggcctgttcctgccttaactgatgacattgtcttgtgaaattccttctcctggctcatcctggctcaaaagctccctcactgagtaccttgtgacccccactcctgccagagaacaaccccccttcttcctttacctacccaaatcctataaaacggccccaccccatctcccttcgctgactctcttttcggactcagcccacctgcacccaggttaaataaacagctttattgctcacacaaagcctgtttggtggtctcttcacagggatgtgcatgaaa

SEQ ID NO: 242 - DNA, 5785 bp, Homo sapiens
gtcaggcctctgagcccaagccaagccatcacatcccctgtgacctgcacgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgaccccaactcctgcgcactgagcaccttacgacccccactcctacccgccagagaacaaaccccctttgactgtaattttcctttacctacccaaatcctataaaacggccccacctttatctccctccgctgactctcttttcggactcaggcgcctgcacccaggtgaaataaacagccatgttgctcacacaaagcctgttttgtggtctcttcacacggacgcgcatgaaatttggtgccatgactcggatcgggggacctcccttgggagatcaatcccctgtcctcctgctctttgctccgtaagaaagatccacctacgacctcaggtcctcagacctaccagcccaggaaacatctcaccaatttcaaatccggtaagcggcctctttttactctcctctccaacctccctcactatccctcaacctctttctcctttcaatcttagcgccacacttcaatctctcccttctcttaatttcaattcctttcattttctggtagagacaaaagagacatgttttatccgtgaacccaaaactccggcgccggtcacagactgggaaggcagccttcccttggtgtttaatcattgcagggacgcctctctgattatacactcatgtttcaagggtgtcagaccacgcagggacacctgccttggtccttcacccttagcggcaagtcccgctttcctggggcaggggcaagtacccctcaaccccttcttcttcacccttagaggcaagtcctgctttcctagggggcaagaagcccccaatcgcttatttccgcaccccaacctcttatctctgtgccccaatcccttatttccgtaccctgacctcttatctctgtgccccaatcccttatttccatgccccaaccccttttctgcttttctggagggcaagaaccccccaccccttctccgtgtctctactcttttctctgggcttgcctccttcactatgggtaagcttccaccttccattcctccttcttctcccttagcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaaaatctaaataattcttttcgtaaaataggcaaacggtctgaggtgcctgacatccaggcattcttttacacatcagtcccttcctagtctctgtgcccagtgcaactcgtcccagatcctccttctttccctcccgcctgtcccctcagtcccaaccccaagcatcgctgagtcttcccagtctttcttttctacagacccatctgacctttcccctcctccccaggctgctcgtcgccaggctgagctaagtcccaatacttcctcagcctccactcctccaccctataatccttctatcacctcccctcctcacacccggtccggcttacagtttagttccacaactagctcttccccacctgcccagcaatttactcttaaaaaggtggctagagccaaaggcataatcaaggttaatgctcctttttctttatcccaaatcagatagcgtttaggctctttttcatcaaatataaaaacccagcccagttcatggctcgttcggcagcaaccctgagacactttacagccctagaccctaaaaggtcaaaaggccatcttattctcaatatacattttattacccaatctgctcccgacattaaataaaactccaaaaattaaattccagccctcaaaccccacaacaggatttaattaacctcgccttcaaggtgtaaaataatagaaaaaagttgcaattccttgcctccactgtgagacaaaccccagccacaatctccagcacacaagaacttccaaatgcctgaaccgcagtggccaggcgttcctccagaacctcctcccacaggagcttgctacatgtgccggaaatctggccactgggccaaggaatgcccgcagcctaggattcctcctaagccatgtcccatctgtgtgggaccccactgaaaatcggactgttcaactcacctggcagccactcccagcttccctggaactctggcccaagcctctctgactgactccttcccagatcttctcggcttagcagctgaagactgacactgcctgatcgcctcgggagccccctagaccatcacggacgccgagcttcgggtaactctcacagtggagggtaagcccgtccccttcttaatcaatacggaggctactcactccacattaccctcttttcaagggcctgtttcctttgccgccataactgttgtgggtattgacggccaggcttctaaacctcttaaaactccccaactctggggccaacttagacaatactcttttaagcactcctttttagttatccccacctgcccagttcccttattaggctgagacactttaactaaattatctgcttccctgactattcctggactacagctgtatctcattgccgcccttcttcccaatccaaagcctcctttgcgtcctccaaagcctcctttgcgtcctcctcttctatcccccaaccttaacccacaagtataagatacctctactccctccttggcgactgatcatgcaccccttaccatctcattaaaacctaatcactcttaccccactcaacaccaatatcccatcccgcagcatgctttaaaaagattaaaggctgttatcactcgcctgctacagcatggccttttaaagcctataaactctccttacaattcccccattttacctgtcctaaaaccagacaagccttacaagttagttcaggatctgcgccttatcaaccaaattgttttgcctatacaccccatggtgccaaacccatatactctcctatcctcaatacctgcctctacaacccattattctgttctggatctcaaacatgctttctttactattcctttgcacccttcatcccagcctctctttgctttcacttagactgaccctgacacccattaggctcagcaaattacctgggctgtactgccacaaggcttcacagacagcccccattacttcagtcaagcccaaatttcatcctcatctgttacctatctcggcataattctcataaaaacacacgtgctttccctgccgatcctgtccgattaatctcccaaacctcaatcccttacaaaacaacaactcctttccttcctaggcatggttagtgtggtcagaattcttacacaagagccaagaccgcaccctgtagcctttctgtccaaacaacttgaccttactgttttagcctagccctcatgtctgtgtgcagcagctgccgctgctttaatacttttagaggccctaaaaatcgcaaactatgctcaactcactctctacatttctcataacttccaaaatctattttcttcctcatacctgacgcatatactttctgctccccggctacttcagctgtacccactctttgttgaggctcccacaattaccgttgttcctggcccagacttcaatccagcctcccacattattcctgataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcaggttatgctatagtacaagccactagcccgcctcttagaacctctcacttcctttccatcgtggaaatctatcctcaagcaaataacttctcagtgttccatctgctgttctactactcctcagggattattcaggacccctcccttccctacacatcaagctccaggatttgccccacccaggactggcaaattagctttactcaacatgccctgagtcagataactaaaatacctcttagtctaggtagatactttcactggataggtagaggcctttcctacagggtctgagaaggccaccgcagtcatttcttccattctgtcagacataattcctcagtttagccttcccacctcaatacagtctgataacagacgagcctctattagtcaaatcagccaagcagtttttcaggctcttagtattcagtgaaacctttatatccctttatggtcctccatcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaacgtcctgtatagacgctcctttttattaggccccagtctcattccagacaccagaccaacttagactgtgcctcaaaaaaaaaaaaaaacttgtcatccctactattttctgtctagtcatactcctattcaccgttctcaactactcatacatgccctgctcttgtttacactgccggtttacactgtttttccaagcgatcacagctgatatctcctggtgctagccccaaactgccactcttaactcttgaagtaaataaataatctttgctggcaggactatgccaaatctccttaagcactctctaatcagacctcctgagtcgtcccaattcttagaccttttatacctgtttttctccttctgttattccatttagtttttcaattcatacaaaaccgtatccaggccatcaccaatcactctatatgacaaatgtttcttctaacatccccacaatatcaccccttaccacaagacctcccttcagcttaatctctcccactctaggttcccacgccgcccctaatcccgcttgaagcagccctgacaaacatcatccattctctctccataccaccccccaaaaattttcgccgccccaacactgcaacactattttgttttatttttcttattaagaaggcaggaatgtcaggcctctgagcccaagccaagccatcacatcccctgtgacctgcacgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcccggctcatcctggctcaaaagcacccccactgagcaccttgcgaccccaactcctgcgcactgagcaccttacgacccccactcctacccgccagagaacaaaccccctttgactgtaattttcctttacctacccaaatcctataaaacggccccacccttatctccctccgctgactctcttttcggactcagcccgcctgcacccaggtgaaataaacagccatgttgctcacacaaagcctgtttggtggtctcttcacatggacgcgcatgaaa

The invention claimed is:

1. A method for detecting at least one RNA transcript, comprising:
    obtaining a biological sample that is collected from a human patient suspected of having lung cancer; and
    detecting, in the biological sample, the presence or absence of at least two RNA transcripts comprising a first RNA transcript expressed by a first nucleic acid sequence having at least 99% identity with SEQ ID NO: 4, and a second RNA transcript expressed by a second nucleic acid sequence having at least 99% identity with SEQ ID NO: 6.

2. The method as claimed in claim 1, wherein the at least two RNA transcripts are mRNA transcripts.

3. The method as claimed in claim 1, wherein the at least two RNA transcripts are detected by hybridization, amplification, or sequencing.

4. The method as claimed in claim 2, wherein the mRNA transcripts are detected by bringing the mRNA transcripts into contact with a probe and/or a primer, and detecting the presence or absence of hybridization to the mRNA transcripts.

5. The method as claimed in claim 2, wherein the mRNA transcripts are detected by detecting the presence or absence of cDNAs obtained from the mRNA transcript transcripts.

6. A method for detecting at least two RNA transcripts, comprising:
    obtaining a biological sample that is collected from a human patient that has been diagnosed with lung cancer; and
    detecting, in the biological sample, the presence or absence of at least two RNA transcripts comprising a first RNA transcript expressed by a first nucleic acid sequence having at least 99% identity with SEQ ID NO:4, and a second RNA transcript expressed by a second nucleic acid sequence having at least 99% identity with SEQ ID NO: 6.

7. The method as claimed in claim 1, further comprising detecting, in the biological sample, the presence or absence of a further RNA transcript expressed by a further nucleic acid sequence having at least 99% identity with SEQ ID NO: 2, 3, 8, 11, 13, 14, 15, 16, 17, 18, 19, 21, 22, 23, 24, 26, 27, 28, 29, 30, 31, 32, 33, 34, 35, 36, 37, 38, 39, 41, 42, 43, 44, 45, 46, 47, 48, 49, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, or 242.

8. The method as claimed in claim 1, further comprising detecting, in the biological sample, the presence or absence of a third RNA transcript expressed by a third nucleic acid sequence having at least 99% identity with SEQ ID NO: 1, 5, 7, or 50.

9. The method as claimed in claim 8, wherein the third nucleic acid sequence has at least 99% identity with SEQ ID NO: 5 or SEQ ID NO: 7.

10. The method according to claim 5, wherein the presence or absence of the cDNAs are detected by bringing the cDNAs into contact with a probe and/or a primer, and detecting the presence or absence of hybridization to the cDNAs.

11. The method as claimed in claim 1, wherein the first nucleic acid sequence is SEQ ID NO: 4, and the second nucleic acid sequence is SEQ ID NO: 6.

12. The method as claimed in claim 11, wherein the at least two RNA transcripts are mRNA transcripts, and
    the mRNA transcripts are detected by detecting the presence or absence of cDNAs obtained from the mRNA transcripts.

13. The method as claimed in claim 11, further comprising determining an expression level of the at least two RNA transcripts in the biological sample.

14. The method as claimed in claim 1, further comprising determining an expression level of the at least two RNA transcripts in the biological sample.

15. A method for detecting at least two RNA transcripts, comprising:
    obtaining a biological sample that is collected from a human patient suspected of having lung cancer; and
    detecting, in the biological sample, the presence or absence of a first RNA transcript expressed by a first nucleic acid sequence having at least 99% identity with SEQ ID NO: 4 by contacting the first RNA transcript or cDNA obtained therefrom with a probe or primers to respectively hybridize to or amplify a region within the first RNA transcript or cDNA obtained therefrom that is defined by a distinct region within the first nucleic acid sequence; and
    detecting, in the biological sample, the presence or absence of a second RNA transcript expressed by a second nucleic acid sequence having at least 99% identity with SEQ ID NO: 6 by contacting the second RNA transcript or cDNA obtained therefrom with a second probe or primers to respectively hybridize to or amplify a region within the second RNA transcript or cDNA obtained therefrom that is defined by a distinct region within the second nucleic acid sequence.

16. The method as claimed in claim 1, wherein no more than 242 specific binding partners are used to detect the at least two RNA transcripts.

* * * * *